United States Patent 7,745,391 (HUMAN THROMBOSPONDIN POLYPEPTIDE) - sequence listing, part 274

SEQ ID NO: 820237 - protein, 650 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKVLSKGPWSGFCYLMSGHSYGCFVLLSFFEPFFCLTNLLETKFTFPFLNIE

SEQ ID NO: 820238 - protein, 1147 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKVQHKLKRGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820239 - protein, 1076 aa, Homo sapiens
MGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820240 - protein, 1094 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820241 - protein, 1140 aa, Homo sapiens; identical to SEQ ID NO: 820236

SEQ ID NO: 820242 - protein, 1126 aa, Homo sapiens; identical to SEQ ID NO: 820235

SEQ ID NO: 820243 - protein, 895 aa, Homo sapiens
SRVSPAEAFTGYLSMPLRNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820244 - protein, 1140 aa, Homo sapiens; identical to SEQ ID NO: 820236

SEQ ID NO: 820245 - protein, 767 aa, Homo sapiens [sequence omitted]

SEQ ID NO: 820246 - protein, 562 aa, Homo sapiens
LGAYEKLVYKEAVRSEFRDIAKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820247 - protein, 340 aa, Homo sapiens [sequence omitted]

SEQ ID NO: 820248 - protein, 156 aa, Homo sapiens
RQPARAPFHQTLVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820249 - protein, 133 aa, Homo sapiens
MGGVTSRGNDHMLQVDECNRNPHRDGIGGGGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820250 - protein, 1140 aa, Homo sapiens; identical to SEQ ID NO: 820236

SEQ ID NO: 820251 - protein, 658 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPE

SEQ ID NO: 820252 - protein, 1140 aa, Homo sapiens; identical to SEQ ID NO: 820236

SEQ ID NO: 820253 - protein, 679 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPELCTVTIHCLFSSVPRNLLCIF

SEQ ID NO: 820254 - protein, 605 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKVQHKL

SEQ ID NO: 820255 - protein, 650 aa, Homo sapiens; identical to SEQ ID NO: 820237

SEQ ID NO: 820256 - protein, 263 aa, Homo sapiens [sequence omitted]

SEQ ID NO: 820257 - protein, 231 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHPPRSSYSP

SEQ ID NO: 820258 - protein, 277 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGRWSSVKIFYKGVTI

SEQ ID NO: 820259 - protein, 152 aa, Homo sapiens
MFVLLFSSFCSFFLFLLAVACLLLVLFFSCVCSGLFYNPCLSFVPPVVYTVPLFVLSRGSLLSRFWFLTILLLCFLSPPLFFICVDIPLRYLCAAVLLLGISFCLLFYLDPCGAPSSSLLLFSINLFLGPLFLAKQFFFFFFFFFFFSHCKI

SEQ ID NO: 820260 - protein, 199 aa, Homo sapiens
MGASLAKPCACRLHVLGSSCPATACRLHPAPLQRFLCSQDSLFRDEQALRATCTFRHYGVFGHVICHRCKNHNREPEAAGMSTCRGTAFSRSFLLFPRSQARPASIPLSRTPQSVWAAGPEWCEPTAALERRRPDEQSDSASAPLQSAILSLLPSGAGELFPRTCFAASLRPRTTGRRRRPLWPCREQGAGEGSGGRPA

SEQ ID NO: 820261 - protein, 152 aa, Homo sapiens; identical to SEQ ID NO: 820259

SEQ ID NO: 820262 - protein, 152 aa, Homo sapiens; identical to SEQ ID NO: 820259

SEQ ID NO: 820263 - protein, 152 aa, Homo sapiens; identical to SEQ ID NO: 820259

SEQ ID NO: 820264 - protein, 152 aa, Homo sapiens; identical to SEQ ID NO: 820259

SEQ ID NO: 820265 - protein, 1780 aa, Homo sapiens [sequence omitted]

SEQ ID NO: 820266 - protein, 1820 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVERSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 820267 - protein, 1031 aa, Homo sapiens
MENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVERSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 820268 - protein, 679 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDII

SEQ ID NO: 820269 - protein, 1787 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVERSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 820270 - protein, 1856 aa, Homo sapiens
LFEFENGNIAVLLAGLASQAKFAGEEVTRGNVWGRRMESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVERSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 820271 - protein, 1820 aa, Homo sapiens; identical to SEQ ID NO: 820266

SEQ ID NO: 820272 - protein, 1031 aa, Homo sapiens; identical to SEQ ID NO: 820267

SEQ ID NO: 820273 - protein, 767 aa, Homo sapiens
QSSNRLLTAQGSTAGEPREGGERLQAVWAPGRGSRRKPSARDMVRAWHHPRREHKNQDDLLKEKETLIQQLKEELQEKNVTLDVQIQHVVEGKRALSELTQGVTCYKAKIKELETILETQKVERSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 820274 - protein, 839 aa, Homo sapiens [sequence omitted]

SEQ ID NO: 820275 - protein, 712 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEEATACLELKFNQIKAELAKTKGELIKTKEELKKRENESDSLIQEL

SEQ ID NO: 820276 - protein, 664 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKD

SEQ ID NO: 820277 - protein, 424 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSK

SEQ ID NO: 820278 - protein, 336 aa, Homo sapiens
LFEFENGNIAVLLAGLASQAKFAGEEVTRGNVWGRRMESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKSKKPKEN

SEQ ID NO: 820279 - protein, 550 aa, Homo sapiens
PEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQRNAYGGFSSTQDTVVALQALAKYATTAYVPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 820280 - protein, 446 aa, Homo sapiens
MTAGDSYDAAVACKQLGCPTAVTAIGRVNASKGFGHIWLDSVSCQGHEPAVWQCKHHEWGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQRNAYGGFSSTQDTVVALQALAKYATTAYVPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 820281 - protein, 550 aa, Homo sapiens; identical to SEQ ID NO: 820279

SEQ ID NO: 820282 - protein, 132 aa, Homo sapiens
PEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTW

SEQ ID NO: 820283 - protein, 412 aa, Homo sapiens [sequence omitted]

SEQ ID NO: 820284 - protein, 251 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 820285 - protein, 78 aa, Homo sapiens
LEKGKESLLEKRLVAEEEEDEEEAEAGSGRSRKRSDFWKMLNEPEDQAPGGEEVPAEEQDPRPRGRSRKQKQEAAEAK

SEQ ID NO: 820286 - protein, 333 aa, Homo sapiens
MAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGESSQTRKSSPVCCFHPSAGSVPRGDPVPSLLRVLILSPLSGTLSSLAPASQHRHPFACLPPIHLSGKQLLEHICWFSGLLLYTQCLALCLAHNG

SEQ ID NO: 820287 - protein, 412 aa, Homo sapiens [sequence omitted]

SEQ ID NO: 820288 - protein, 412 aa, Homo sapiens [sequence omitted]

SEQ ID NO: 820289 - protein, 412 aa, Homo sapiens [sequence omitted]

SEQ ID NO: 820290 - protein, 357 aa, Homo sapiens [sequence omitted]

SEQ ID NO: 820291 - protein, 373 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGESSQTRKSSPVCCFHPSAGSVPRGDPVPSLLRVLILSPLSGTLSSLAPASQHRHPFACLPPIHLSGKQLLEHICWFSGLLLYTQCLALCLAHNG

SEQ ID NO: 820292 - protein, 397 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 820293 - protein, 354 aa, Homo sapiens
MLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 820294 - protein, 372 aa, Homo sapiens [sequence omitted]

SEQ ID NO: 820295 - protein, 373 aa, Homo sapiens; identical to SEQ ID NO: 820291

SEQ ID NO: 820296 - protein, 354 aa, Homo sapiens; identical to SEQ ID NO: 820293

SEQ ID NO: 820297 - protein, 342 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 820298 - protein, 257 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPEL

SEQ ID NO: 820299 - protein, 412 aa, Homo sapiens [sequence omitted]

SEQ ID NO: 820300 - protein, 412 aa, Homo sapiens [sequence omitted]

SEQ ID NO: 820301 - protein, 412 aa, Homo sapiens [sequence omitted]

SEQ ID NO: 820302 - protein, 412 aa, Homo sapiens [sequence omitted]

SEQ ID NO: 820303 - protein, 412 aa, Homo sapiens [sequence omitted]

SEQ ID NO: 820304 - protein, 412 aa, Homo sapiens [sequence omitted]

SEQ ID NO: 820305 - protein, 442 aa, Homo sapiens
MSCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 820306 - protein, 372 aa, Homo sapiens [sequence omitted]

SEQ ID NO: 820307 - protein, 412 aa, Homo sapiens [sequence omitted]

SEQ ID NO: 820308 - protein, 353 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEVIF

SEQ ID NO: 820309 - protein, 317 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRVNGPEGIL

SEQ ID NO: 820310 - protein, 279 aa, Homo sapiens
MAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKLRPEKSHLK

SEQ ID NO: 820311 - protein, 224 aa, Homo sapiens
MGEHPGLSRWSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 820312 - protein, 252 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLLPPPSPPAPTQCCTAGHPLSPFPTA

SEQ ID NO: 820313 - protein, 252 aa, Homo sapiens; identical to SEQ ID NO: 820312

SEQ ID NO: 820314 - protein, 182 aa, Homo sapiens
DLLPSDHLPGALQRFLREARAPMSLPHVCALVCKVHTVRAKKGCPQSPSTTKEDPDHPVVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 820315 - protein, 252 aa, Homo sapiens; identical to SEQ ID NO: 820312

SEQ ID NO: 820316 - protein, 252 aa, Homo sapiens; identical to SEQ ID NO: 820312

SEQ ID NO: 820317 - protein, 266 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLLPPPSPPAPPGAGAPSDIPRRGEGQKGERNMREEREGKT

SEQ ID NO: 820318 - protein, 216 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRSLSLPTLSPTICASELRSLHLCC

SEQ ID NO: 820319 - protein, 105 aa, Homo sapiens
MLKSFQSANIIELLHYHQCDSRSSTKAEILKCLLNLQIQHIDARFAVLLTGNSQAHFTQLMPKLVSSRNVKVRYLMKSIRYLNGLASHGYQNHPNLLKLKPLYKM

SEQ ID NO: 820320 - protein, 1086 aa, Homo sapiens
VYPSVSEEPVENKERKGDNLQPVTLILSKENCTLEIAEEINVTSDFPFDSVIEEVSPASSPEPPVPVKETRPYQAVTPCILKLHGTQCEKSNQISQCESEDLGITEKENVFVGPTHPVGQDNFTQVQQMQVSAEMPLILTDHPGRTGRPTLPGKVTEEIVSSEHDEGLSFSGKVQCYGRELNQPASAAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPAFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITKELKDTMRTSHGLRRHPSFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHNRDLRNSQRNHTVSFHLNKLKYNSTVKESRNDISLILNEYAEFNKVMKNSNQFIFQDKELNDVSGEATAQEMYLPFPGRSASYEDIIIDVCTNLHVKLRSVVKEACKSTFLFYLVETEDKSFFVRTKNLLRKGGHTEIEPQHFCQAFHRENDTLIIIIRNEDISSHLHQIPSLLKLKHFPSVIFAGVDSPGDVLDHTYQELFRAGGFVISDDKILEAVTLVQLKEIIKILEKLNGNGRWKWLLHYRENKKLKEDERVDSTAHKKNIMLKSFQSANIIELLHYHQCDSRSSTKAEILKCLLNLQIQHIDARFAVLLTDKPTIPREVFENNGILVTDVNNFIENIEKIAAPFRSSYW

SEQ ID NO: 820321 - protein, 1086 aa, Homo sapiens; identical to SEQ ID NO: 820320

SEQ ID NO: 820322 - protein, 1068 aa, Homo sapiens
VYPSVSEEPVENKERKGDNLQPVTLILSKENCTLEIAEEINVTSDFPFDSVIEEVSPASSPEPPVPVKETRPYQAVTPCILKLHGTQCEKSNQISQCESEDLGITEKENVFVGPTHPVGQDNFTQVQQMQVSAEMPLILTDHPGRTGRPTLPGKVTEEIVSSEHDEGLSFSGKVQCYGRELNQPASAAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPAFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHNRDLRNSQRNHTVSFHLNKLKYNSTVKESRNDISLILNEYAEFNKVMKNSNQFIFQDKELNDVSGEATAQEMYLPFPGRSASYEDIIIDVCTNLHVKLRSVVKEACKSTFLFYLVETEDKSFFVRTKNLLRKGGHTEIEPQHFCQAFHRENDTLIIIIRNEDISSHLHQIPSLLKLKHFPSVIFAGVDSPGDVLDHTYQELFRAGGFVISDDKILEAVTLVQLKEIIKILEKLNGNGRWKWLLHYRENKKLKEDERVDSTAHKKNIMLKSFQSANIIELLHYHQCDSRSSTKAEILKCLLNLQIQHIDARFAVLLTDKPTIPREVFENNGILVTDVNNFIENIEKIAAPFRSSYW

SEQ ID NO: 820323 - protein, 1086 aa, Homo sapiens; identical to SEQ ID NO: 820320

SEQ ID NO: 820324 - protein, 800 aa, Homo sapiens
VYPSVSEEPVENKERKGDNLQPVTLILSKENCTLEIAEEINVTSDFPFDSVIEEVSPASSPEPPVPVKETRPYQAVTPCILKLHGTQCEKSNQISQCESEDLGITEKENVFVGPTHPVGQDNFTQVQQMQVSAEMPLILTDHPGRTGRPTLPGKVTEEIVSSEHDEGLSFSGKVQCYGRELNQPASAAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPAFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITKELKDTMRTSHGLRRHPSFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHNRDLRNSQRNHTVSFHLNKLKYNSNLCRLKCPCVTALKRAVVLPARSLRSENGQTASSSESLTPDPQAA

SEQ ID NO: 820325 - protein, 207 aa, Homo sapiens
MRTCERLVKEGRFVPSNPIGILTTSYCELLQNKVPLLGSSTACIVVLDRTSHRLHTANLGDSGFLVVRGGEVVHRSDEQQHYFNTPFQLSIAPPEAEGVVLSDSPDAADSTSFDVQLGDIILTATDGLFDNMPDYMILQELKKLKNSNYESIQQTARSIAEQAHELAYDPNYMSPFAQFACDNGLNVRGGKPDDITVLLSIVAEYTD

SEQ ID NO: 820326 - protein, 207 aa, Homo sapiens; identical to SEQ ID NO: 820325

SEQ ID NO: 820327 - protein, 207 aa, Homo sapiens; identical to SEQ ID NO: 820325

SEQ ID NO: 820328 - protein, 207 aa, Homo sapiens; identical to SEQ ID NO: 820325

SEQ ID NO: 820329 - protein, 60 aa, Homo sapiens
MFSVLSYGRLVARAVLGGLSQTDPRAGGGGGGDYGLVTAGCGFGKDFRKGLLKKGACYGD

SEQ ID NO: 820330 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 820331 - protein, 167 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYAC

SEQ ID NO: 820332 - protein, 173 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENP

SEQ ID NO: 820333 - protein, 159 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERTGNRDEDKT

SEQ ID NO: 820334 - protein, 168 aa, Homo sapiens
AGLGGRPGPTVAGSAPTEAPRGSRPFGGRGSCRRGWGAGRGRAVFVFVFVLSSRCGRSSRVASGWPSPGRRDAWHLRPPLASLRPQTALLGFDPEPGSRLTTCSRSHSWSGAGRDGGRRPLQGDGAAAGVSLQPPAFTPPLPPGRSSTHSSERSHLCLRKEGVPKARL

SEQ ID NO: 820335 - protein, 101 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFELITMR

SEQ ID NO: 820336 - protein, 168 aa, Homo sapiens; identical to SEQ ID NO: 820334

SEQ ID NO: 820337 - protein, 180 aa, Homo sapiens; identical to SEQ ID NO: 820330

SEQ ID NO: 820338 - protein, 180 aa, Homo sapiens; identical to SEQ ID NO: 820330

SEQ ID NO: 820339 - protein, 180 aa, Homo sapiens; identical to SEQ ID NO: 820330

SEQ ID NO: 820340 - protein, 207 aa, Homo sapiens
MAPGVARGPTPYWRLRLGGAALLLLLIPVAAAQEPPGAAGFLNTRSTCLEEGIVISRGSGRGPSFACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 820341 - protein, 168 aa, Homo sapiens; identical to SEQ ID NO: 820334

SEQ ID NO: 820342 - protein, 200 aa, Homo sapiens
MAPPRRSTSGAAAVPGGDRLCWSRSCNAPLTDRATGRPWRPEWPAGRRRTGGCASVAPRCSCCSSRWPPRRSLPELCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 820343 - protein, 159 aa, Homo sapiens
MGQAVSCVLGRLQPVKCTGARRVGRRGLRKQTSQECLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 820344 - protein, 194 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFELRSPAQPGDHVAIAVS

SEQ ID NO: 820345 - protein, 152 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERPV

SEQ ID NO: 820346 - protein, 115 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWAPGHCHLLLLLLQEEEEPEAGQE

SEQ ID NO: 820347 - protein, 107 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWGLFKEENPYARFENN

SEQ ID NO: 820348 - protein, 180 aa, Homo sapiens; identical to SEQ ID NO: 820330

SEQ ID NO: 820349 - protein, 180 aa, Homo sapiens; identical to SEQ ID NO: 820330

SEQ ID NO: 820350 - protein, 180 aa, Homo sapiens; identical to SEQ ID NO: 820330

SEQ ID NO: 820351 - protein, 180 aa, Homo sapiens; identical to SEQ ID NO: 820330

SEQ ID NO: 820352 - protein, 180 aa, Homo sapiens; identical to SEQ ID NO: 820330

SEQ ID NO: 820353 - protein, 180 aa, Homo sapiens; identical to SEQ ID NO: 820330

SEQ ID NO: 820354 - protein, 180 aa, Homo sapiens; identical to SEQ ID NO: 820330

SEQ ID NO: 820355 - protein, 80 aa, Homo sapiens
PGSLCFLERDCAILAPFTRSRNPLFKPVPVHRPDERVGGSIGGGNNLELEPQEGFSEDVHVQDPPDGEMEKELDRGEGTA

SEQ ID NO: 820356 - protein, 180 aa, Homo sapiens; identical to SEQ ID NO: 820330

SEQ ID NO: 820357 - protein, 180 aa, Homo sapiens; identical to SEQ ID NO: 820330

SEQ ID NO: 820358 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFEKL

SEQ ID NO: 820359 - protein, 179 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYENCNLKETIKLGVP

SEQ ID NO: 820360 - protein, 200 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDEHANEDVERMLLGNKCDMDDKRVVPKGKGEQIAREHGIRFFETSAKANINIEKAFLTLAEDILRKTPVKEPNSENVDISSGGGVTGWKSKCC

SEQ ID NO: 820361 - protein, 200 aa, Homo sapiens; identical to SEQ ID NO: 820360

SEQ ID NO: 820362 - protein, 107 aa, Homo sapiens
MPSCARAQRRTARLGREGRAGVRPCVRLRQRARRRERARGKGGSGRGGSVSWGYVTELVDLGVLLRCPRRVLAGSFRSGERLSSRPLRLLDGRAGLLARGSVPAEKP

SEQ ID NO: 820363 - protein, 200 aa, Homo sapiens; identical to SEQ ID NO: 820360

SEQ ID NO: 820364 - protein, 200 aa, Homo sapiens; identical to SEQ ID NO: 820360

SEQ ID NO: 820365 - protein, 200 aa, Homo sapiens; identical to SEQ ID NO: 820360

SEQ ID NO: 820366 - protein, 200 aa, Homo sapiens; identical to SEQ ID NO: 820360

SEQ ID NO: 820367 - protein, 172 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDERWGLAVLPRLVSNSRGQVILPSQPPKKLGLQPTQFEDIEDEDLYDDPLPLNKYMPMKMWKECY

SEQ ID NO: 820368 - protein, 200 aa, Homo sapiens; identical to SEQ ID NO: 820360

SEQ ID NO: 820369 - protein, 182 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFEKMLLGNKCDMDDKRVVPKGKGEQIAREHGIRFFETSAKANINIEKAFLTLAEDILRKTPVKEPNSENVDISSGGGVTGWKSKCC

SEQ ID NO: 820370 - protein, 118 aa, Homo sapiens
MGIMLVYDITNGKSFENISKWLRNIDEHANEDVERMLLGNKCDMDDKRVVPKGKGEQIAREHGIRFFETSAKANINIEKAFLTLAEDILRKTPVKEPNSENVDISSGGGVTGWKSKCC

SEQ ID NO: 820371 - protein, 200 aa, Homo sapiens; identical to SEQ ID NO: 820360

SEQ ID NO: 820372 - protein, 200 aa, Homo sapiens; identical to SEQ ID NO: 820360

SEQ ID NO: 820373 - protein, 200 aa, Homo sapiens; identical to SEQ ID NO: 820360

SEQ ID NO: 820374 - protein, 200 aa, Homo sapiens; identical to SEQ ID NO: 820360

SEQ ID NO: 820375 - protein, 177 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDERWGLAVLPRLVSNSRGQVILPSQPPKKLGLQVCATTPSSINRFLKTNLLEKMLETCNNLKNSQTSHIT

SEQ ID NO: 820376 - protein, 771 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 820377 - protein, 737 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 820378 - protein, 760 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 820379 - protein, 418 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEERRKEERRRRRKKKNKEKKKEEGRRRRKEGEEEKEEGERKGEGKGKEGEERRTKKKERKNKKERRKKKVKEEERRKKERRGRTKKKEEERRKKNKEERRRRKNKKRKKKKKKRRRKEGEKGRKKEEESRKRKKEKKV

SEQ ID NO: 820380 - protein, 242 aa, Homo sapiens
TSGYFQDEECVRLDKERLAARLEGHKEGIVQTEQIRSLSEAMSVEKIAAIKAKIMAKKRSTIKTDLDDDITALKQRSFVDAEVDVTRDIVSRERVWRTRTTILQSTGKNFSKNIFAILQSVKAREEGRAPEQRPAPNAAPVDPTLRTKQPIPAASAPSEKKKKKKKKKKKKKKKKKKKRKKKKKKKRDKRRIKRRATKQEKPKKRLEKRGKKKKHRRQKRQQENEKKEKKRRKKKKKKGTQP

SEQ ID NO: 820381 - protein, 125 aa, Homo sapiens
WLVLLLLVRRGGEGGGGRGRGDKRRRRQARRQRRRPEPAEARGGKMADVLSVLRQYNIQKKEIVVKGDEVIFGEFSWPKNVKTNYVVWGTGKEGQPREYYTLDSILFLLNNVHLSHPVYVRRAAT

SEQ ID NO: 820382 - protein, 576 aa, Homo sapiens
WLVLLLLVRRGGEGGGGRGRGDKRRRRQARRQRRRPEPAEARGGKMADVLSVLRQYNIQKKEIVVKGDEVIFGEFSWPKNVKTNYVVWGTGKEGQPREYYTLDSILFLLNNVHLSHPVYVRRAATENIPVVRRPDRKDLLGYLNGEASTSASIDRSAPLEIGLQRSTQVKRAADEVLAEAKKPRIEDEECVRLDKERLAARLEGHKEGIVQTEQIRSLSEAMSVEKIAAIKAKIMAKKRSTIKTDLDDDITALKQRSFVDAEVDVTRDIVSRERVWRTRTTILQSTGKNFSKNIFAILQSVKAREEGRAPEQRPAPNAAPVDPTLRTKQPIPAAYNRYDQERFKGKEETEGFKIDTMGTYHGMTLKSVTEGASARKTQTPAAQPVPRPVSQARPPPNQKKGSRTPIIIIPAATTSLITMLNAKDLLQDLKFVPSDEKKKQGCQRENETLIQRRKDQMQPGGTAISVTVPYRVVDQPLKLMPQDWDRVVAVFVQGPAWQFKGWPWLLPDGSPVDIFAKIKAFHLKYDEVRLDPNVQKWDVTVLELSYHKRHLDRPVFLRFWETLDRYMVKHKSHLRF

SEQ ID NO: 820383 - protein, 576 aa, Homo sapiens; identical to SEQ ID NO: 820382

SEQ ID NO: 820384 - protein, 576 aa, Homo sapiens; identical to SEQ ID NO: 820382

SEQ ID NO: 820385 - protein, 484 aa, Homo sapiens
WLVLLLLVRRGGEGGGGRGRGDKRRRRQARRQRRRPEPAEARGGKMADVLSVLRQYNIQKKEIVVKGDEVIFGEFSWPKNVKTNYVVWGTGKEGQPREYYTLDSILFLLNNVHLSHPVYVRRAATENIPVVRRPDRKDLLGYLNGEASTSASIDRSAPLEIGLQRSTQVKRAADEVLAEAKKPRIEDEECVRLDKERLAARLEGHKEGIVQTEQIRSLSEAMSVEKIAAIKAKIMAKKRSTIKTDLDDDITALKQRSFVDAEVDVTRDIVSRERVWRTRTTILQSTGKNFSKNIFAILQSVKAREEGRAPEQRPAPNAAPVDPTLRTKQPIPAAYNRYDQERFKGKEETEGFKIDTMGTYHGMTLKSVTEGASARKTQTPAAQPVPRPVSQARPPPNQKKGSRTPIIIIPAATTSLITMLNAKDLLQDLKFVPSDEKKKQGCQRENETLIQRRKDQMQPGGTAISVTVPYRVVDQPLKLMPQDC

SEQ ID NO: 820386 - protein, 334 aa, Homo sapiens [sequence omitted]

SEQ ID NO: 820387 - protein, 334 aa, Homo sapiens [sequence omitted]

SEQ ID NO: 820388 - protein, 334 aa, Homo sapiens [sequence omitted]

SEQ ID NO: 820389 - protein, 334 aa, Homo sapiens [sequence omitted]

SEQ ID NO: 820390 - protein, 717 aa, Homo sapiens
MIDPDFADKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 820391 - protein, 895 aa, Homo sapiens
MFPTGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 820392 - protein, 915 aa, Homo sapiens
PTQVLRTWGLRDLGAMKSVCPVTSGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 820393 - protein, 912 aa, Homo sapiens
MSQSSGSGDGNDDEATTSKDGGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 820394 - protein, 912 aa, Homo sapiens; identical to SEQ ID NO: 820393

SEQ ID NO: 820395 - protein, 266 aa, Homo sapiens
MFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 820396 - protein, 895 aa, Homo sapiens
MFPTGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKGVICSSQWIN

SEQ ID NO: 820397 - protein, 841 aa, Homo sapiens
MFPTGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVFLSLSLSPNTLELYMLIIKIYKDFYTC

SEQ ID NO: 820398 - protein, 714 aa, Homo sapiens
MGWLWIQKKLLIRFCVCRLNLFRVFQQHEFKRDASVWVSDRDLYLFRGITEGGSVPGASMLTTSRLSHYPAAKFGASMYMAIPCAYVCIQTRMHAWMDIRMHRLFFKDNSFNKVFTPYLKQVFMKKMHKSCLAGIIHEEGAGSVGQRTQDQFAIPRPKVGDSGFLFGGWIPCAVFYLVIVFLPEAAPRSRIASCDSILCMPFLGKVSGCRDAGAGRVGCAWRPVPPVGWARCSAWCWGAARASSDPRASITGGGGGGGGGAVTLCAPCAPALLAAGSAGLCTRALAAGSIGASAGGLGIAFRGTGVFLCCLGCCSGLFRRTAVACLVESEIRMMLAAETEGIAFFFPLNPEPPENIPKAKSFPNPQPDPTKPKPNSYSIGDSCLPASRESVPSKLCPTFYYLLNGNTDGAEWSLMILSRLLRTPECGSGAEELGGSALVSFNVAGLVSVAGQEYFCGYGPSLNFGGSGCRKRVCRSGRWVSSTLALFLVYADVSGSPWHCNHSSQVPTGYLECFGFVNSGVHFGCYGGREEEKRENEVFAELICMAVFSSPCLCDYVMIRRVPKQLPTIILALPQTEEVGCYSCLRRLYVIMCMLGAGREWGQGGIIQQLKCEEYRSVIVCPSEDSVVLALGQCGSEDPPVSLSASNCLSELSFGNFTPLAPWRQLDPGEGPLQGLQFPNSRQKMNPEAKVIGQVPAVLHGPAEQPVQGGVPVH

SEQ ID NO: 820399 - protein, 102 aa, Homo sapiens
PRAHGSRMPWPGGCSAAPRRTPDPSRSRRPAGAQVFMKKMHKILPGRNEFMKKGLDPWVREHRTSLPSQGRSRGTNVLKNGKKGGSEGTDSNTMPEVEDTGA

SEQ ID NO: 820400 - protein, 776 aa, Homo sapiens
MNLFRVFQQHEFKRDASVWVSDRDLYLFRGITEGGSVPGASMLTTSRLSHYPAAKFGASMYMAIPCAYVCIQTRMHAWMDIRMHRLFFKDNSFNKVFTPYLKQVFMKKMHKILPGRNEFMKKGLDPWVREHRTSLPSQGRSLVSRICSCVAHSCWILSSRGTNVLKNGKKGGSEGTDSNTMPEVEDTGAVKGNWHTLEPQEELELEACGPRRVEVPAMTKSPSHHLAIHPEPTEWRTAQRGLSHFVTAKAENKSQRSQRSSTSPTAFRITLRKWLNFDQFCNVDTMRRDLPSCTGFIIIPGGHSSWDFGHLISTFKHVIPISAVVALGILSLGENINLFSLLSSVIKLSYLKLGHFRLEAPLDIPVLRSCQVHVISVSLLTGSTSARGCLARSVCLLVSSLMPFSSPLPNPSETCTVVTLSPPGALTGCVRESMVCGTDIFVCLEVTGTRIHPWRKVAVKEASLSSAFYSHRSYSRLFECLPYSRIIVLFFFQLNVSIAIFHYCKAAHACYKNFGSVDKEKEEKATSKSYLPQRQDDHLVIIVSYIYNMYTYDFNVSVVSQYHVYVFHKTRWHLISYDEQLSRATSLVYSNCNVRVLIYIATASFVYLISYGLMFRLFPTFLHLNSINKCGFSFKKKKKKKKKKNKNKHQQKKHKKKQQTQNNKQKKRANTTKKYQTTQETRTKNTNPTRETNKKTNEQKKEEQHKKKRNHKRTDKKQTKQDKREKKNTEKKEKQKTKEKKKNNERTDNNMANQKTADKKIKNTQKKKNTQENTRT

SEQ ID NO: 820401 - protein, 103 aa, Homo sapiens
PRAHGSRMPWPGGCSAAPRRTPDPSRSRRPAGAQVFMKKMHKSCLAGIIHEEGAGSVGQRTQDQFAIPRPKSGVSDLFLCCPLLLDLVQSRDKRPEEWEERRF

SEQ ID NO: 820402 - protein, 530 aa, Homo sapiens
MPQTPCSLPARSCFPRPPPFHQSSLGWFLCIYISPVPLHIPSPHLGFSSFGLIPLRPLTVSLLQPSVPSDVEPQDLAPLVEPHSGRLSLPPNVCPVLREFRVEVLFWGLRGLGRVHLLEVEQPQVVLEVAGQRVESEVLASYRESPNFTELVRHLSVDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEVKGTVSPKKAVATLKIYNRSLEEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVWVQQGPQEPF

SEQ ID NO: 820403 - protein, 516 aa, Homo sapiens
ALAAPRVKLMEDPYQRPELQFFPLRKGPWAAGELIAAFQLIELDYSGRLEPSVPSDVEPQDLAPLVEPHSGRLSLPPNVCPVLREFRVEVLFWGLRGLGRVHLLEVEQPQVVLEVAGQRVESEVLASYRESPNFTELVRHLSVDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEVKGTVSPKKAVATLKIYNRSLEEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVWVQQGPQEPF

SEQ ID NO: 820404 - protein, 530 aa, Homo sapiens; identical to SEQ ID NO: 820402

SEQ ID NO: 820405 - protein, 486 aa, Homo sapiens
MPQTPCSLPARSCFPRPPPFHQSSLGWFLCIYISPVPLHIPSPHLGFSSFGLIPLRPLTVSLLQPSVPSDVEPQDLAPLVEPHSGRLSLPPNVCPVLREFRVEVLFWGLRGLGRVHLLEVEQPQVVLEVAGQRVESEVLASYRESPNFTELVRHLSVDLPEQPYLQPPLSILVIERRAFGHTVLVGSHIVPHMLRFTFRGHEDPPEEEGEMEETGDMMPKGPQGQKSLDPFLAEAGISRQLLKHNFDEDEMDDPGDSDGVNLISMVGEIQDQGEAEVKGTVSPKKAVATLKIYNRSLEEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVWVQQGPQEPF

SEQ ID NO: 820406 - protein, 328 aa, Homo sapiens [sequence omitted]

SEQ ID NO: 820407 - protein, 530 aa, Homo sapiens; identical to SEQ ID NO: 820402

SEQ ID NO: 820408 - protein, 331 aa, Homo sapiens
FGTELGVEQAHLEERCALTPKAFGRPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 820409 - protein, 201 aa, Homo sapiens
MPQTPCSLPARSCFPRPPPFHQSSLGWFLCIYISPVPLHIPSPHLGFSSFGLIPLRPLTVSLLQPSVPSDVEPQDLAPLVEPHSGRLSLPPNVCPVLREFRVEVLFWGLRGLGRVHLLEVEQPQVVLEVAGQRVESEVLASYRESPNFTELVRHLSLQQVTDSSCSSPPFGQRLQGHLSVCGSLLSIIQGSHQDFVEEVAL

SEQ ID NO: 820410 - protein, 313 aa, Homo sapiens
MPQTPCSLPARSCFPRPPPFHQSSLGWFLCIYISPVPLHIPSPHLGFSSFGLIPLRPLTVSLLQPSVPSDVEPQDLAPLVEPHSGRLSLPPNVCPVLREFRVEVLFWGLRGLGRVHLLEVEQPQVVLEVAGQRVESEVLASYRESPNFTELVRHLSVDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQRWGLYLLSRLVSNSWVQVIFPPQPPQ

SEQ ID NO: 820411 - protein, 118 aa, Homo sapiens
EEWVLHVAPALTLTHPGPSWVKGLEHDKQETDVHFNSLTGEGNFNWRFVFRFDYLPTEREVSVWRRSGPFALEEAEFRQPAVLVLQVWDYDRISANDFLGITMLSLPHPQPLPPALTS

SEQ ID NO: 820412 - protein, 81 aa, Homo sapiens
VAWGGGERPGTRTWRWSADASLSQGKTKELGEQSASTSSRFDQPFFSEQETYHTAREDTRRRHLFTHQEERPHKNPIMMAL

SEQ ID NO: 820413 - protein, 639 aa, Homo sapiens
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 820414 - protein, 169 aa, Homo sapiens
MERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 820415 - protein, 372 aa, Homo sapiens
MLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 820416 - protein, 639 aa, Homo sapiens; identical to SEQ ID NO: 820413

SEQ ID NO: 820417 - protein, 600 aa, Homo sapiens
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQEFCRLHRKHG

SEQ ID NO: 820418 - protein, 360 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWCILDVYSRPNPSIAFRFPIQGQG

SEQ ID NO: 820419 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 820420 - protein, 1112 aa, Homo sapiens; identical to SEQ ID NO: 820419

SEQ ID NO: 820421 - protein, 379 aa, Homo sapiens
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 820422 - protein, 379 aa, Homo sapiens; identical to SEQ ID NO: 820421

SEQ ID NO: 820423 - protein, 379 aa, Homo sapiens; identical to SEQ ID NO: 820421

SEQ ID NO: 820424 - protein, 379 aa, Homo sapiens; identical to SEQ ID NO: 820421

SEQ ID NO: 820425 - protein, 379 aa, Homo sapiens; identical to SEQ ID NO: 820421

SEQ ID NO: 820426 - protein, 379 aa, Homo sapiens; identical to SEQ ID NO: 820421

SEQ ID NO: 820427 - protein, 379 aa, Homo sapiens; identical to SEQ ID NO: 820421

SEQ ID NO: 820428 - protein, 379 aa, Homo sapiens; identical to SEQ ID NO: 820421

SEQ ID NO: 820429 - protein, 379 aa, Homo sapiens; identical to SEQ ID NO: 820421

SEQ ID NO: 820430 - protein, 379 aa, Homo sapiens; identical to SEQ ID NO: 820421

SEQ ID NO: 820431 - protein, 379 aa, Homo sapiens; identical to SEQ ID NO: 820421

SEQ ID NO: 820432 - protein, 379 aa, Homo sapiens; identical to SEQ ID NO: 820421

SEQ ID NO: 820433 - protein, 379 aa, Homo sapiens; identical to SEQ ID NO: 820421

SEQ ID NO: 820434 - protein, 327 aa, Homo sapiens
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEEIFRLKMR

SEQ ID NO: 820435 - protein, 76 aa, Homo sapiens
FETLLDPPGCLNSALPEGGPACGGGKKEEEKEIVPNPCRSVPGRFHKVGVLEGVGPRPSRVLRRLRRLSHSPPAFQ

SEQ ID NO: 820436 - protein, 1848 aa, Homo sapiens
DHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 820437 - protein, 1854 aa, Homo sapiens
DHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTGAATNAADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 820438 - protein, 1124 aa, Homo sapiens
GRSPGGRLRAGPPRPPAGPPPLPPCPQPGSGGGGGSGSRRRSIMPRRKQQAPRRAAAYVSEELKAAALVDEGLDPEEHTADGEPSAKYMCPEKELARACPSYQNSPAAEFSCHEMDSESHISETSDRMADFESGSIKNEEETKEVTVPLEDTTVSDSLEQMKAVYNNFLSNSYWSNLNLNLHQPSSEKNNGSSSSSSSSSSSCGSGSFDWHQSAMAKTLQQVSQSRMLPEPSLFSTVQLYRQSSKLYGSIFTGASKFRCKDCSAAYDTLVELTVHMNETGHYRDDNHETDNNNPKRWSKPRKRSLLEMEGKEDAQKVLKCMYCGHSFESLQDLSVHMIKTKHYQKVPLKEPVTPVAAKIIPATRKKASLELELPSSPDSTGGTPKATISDTNDALQKNSNPYITPNNRYGHQNGASYAWHFEARKSQILKCMECGSSHDTLQELTAHMMVTGHFIKVTNSAMKKGKPIVETPVTPTITTLLDEKVQSVPLAATTFTSPSNTPASISPKLNVEVKKEVDKEKAVTDEKPKQKDKPGEEEEKCDISSKYHYLTENDLEESPKGGLDILKSLENTVTSAINKAQNGTPSWGGYPSIHAAYQLPNMMKLSLGSSGKSTPLKPMFGNSEIVSPTKNQTLVSPPSSQTSPMPKTNFHAMEELVKKVTEKVAKVEEKMKEPDGKLSPPKRATPSPCSSEVGEPIKMEASSDGGFRSQENSPSPPRDGCKDGSPLAEPVENGKELVKPLASSLSGSTAIITDHPPEQPFVNPLSALQSVMNIHLGKAAKPSLPALDPMSMLFKMSNSLAEKAAVATPPPLQSKKADHLDRYFYHVNNDQPIDLTKGKSDKGCSLGSVLLSPTSTAPATSSSTVTTAKTSAVVSFMSNSPLRENALSDISDMLKNLTESHTSKSSTPSSISEKSDIDGATLEEAEESTPAQKRKGRQSNWNPQHLLILQAQFAASLRQTSEGKYIMSDLSPQERMHISRFTGLSMTTISHWLANVKYQLRRTGGTKFLKNLDTGHPVFFCNDCASQIRTPSTYISHLESHLGFRLRDLSKLSTEQINSQIAQTKSPSEKMVTSSPEEDLGTSYQCKLCNRTFASKHAVKLHLSKTHGKSPEDHLLYVSELEKQ

SEQ ID NO: 820439 - protein, 127 aa, Homo sapiens
RPLSGGEAESRPASPPRGPAAPPSLSSARQRRRRRQWQSPEKHHAEEEAAGAPARSRQEHQLGGGSQHVVGGERAALVSSHYPCVPVEPKTPGKEANPRAPKPPFPKRIESQSPRNGALSGGPRWRR

SEQ ID NO: 820440 - protein, 1124 aa, Homo sapiens; identical to SEQ ID NO: 820438

SEQ ID NO: 820441 - protein, 474 aa, Homo sapiens
SRGDWLRHAPPLAPPGGRLRGGDGGVVPPYKNGGGGGGTAHSVPLPRGCRGRAAPAGACPRQGPASVASSSIAQFPQPEHPLKMAEESSCTRDCMSFSVLNWDQVSRLHEVLTEVVPIHGRGNFPTLEITLKDIVQTVRSRLEEAGIKVHDVRLNGSAAGHVLVKDNGLGCKDLDLIFHVALPTEAEFQLVRDVVLCSLLNFLPEGVNKLKISPVTLKEAYVQKLVKVCTDTDRWSLISLSNKNGKNVELKFVDSIRRQFEFSVDSFQIILDSLLFFYDCSNNPISEHFHPTVIGESMYGDFEEAFDHLQNRLIATKNPEEIRGGGLLKYSNLLVRDFRPTDQEEIKTLERYMCSRFFIDFPDILEQQRKLETYLQNHFAEEERSKYDYLMILRRVVNESTVCLMGHERRQTLNLISLLALRVLAEQNIIPSATNVTCYYQPAPYVSDGNFSNYYVAHPPVTYSQPYPTWLPCN

SEQ ID NO: 820442 - protein, 474 aa, Homo sapiens; identical to SEQ ID NO: 820441

SEQ ID NO: 820443 - protein, 263 aa, Homo sapiens [sequence omitted]

SEQ ID NO: 820444 - protein, 263 aa, Homo sapiens [sequence omitted]

SEQ ID NO: 820445 - protein, 263 aa, Homo sapiens [sequence omitted]

SEQ ID NO: 820446 - protein, 263 aa, Homo sapiens [sequence omitted]

SEQ ID NO: 820447 - protein, 507 aa, Homo sapiens
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 820448 - protein, 485 aa, Homo sapiens
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 820449 - protein, 1524 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 820450 - protein, 1556 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 820451 - protein, 1556 aa, Homo sapiens; identical to SEQ ID NO: 820450

SEQ ID NO: 820452 - protein, 1240 aa, Homo sapiens [sequence omitted]

SEQ ID NO: 820453 - protein, 1530 aa, Homo sapiens
MGFCFCFCFLISDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 820454 - protein, 1322 aa, Homo sapiens
VTREPLTADEEEALKQEHQRKEKELLEKIQSAIACTNIFPLGRDLPYRVHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 820455 - protein, 1155 aa, Homo sapiens [sequence omitted]

SEQ ID NO: 820456 - protein, 1030 aa, Homo sapiens [sequence omitted]

SEQ ID NO: 820457 - protein, 1485 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVITRLDKMYSCILSDLVHVITLK

SEQ ID NO: 820458 - protein, 1399 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFNAIPIKLPIDFLHRTGKTTKVI

SEQ ID NO: 820459 - protein, 604 aa, Homo sapiens
SASISQIHHIPLPPYGEVAFEIGLKDSRFGVGQLGNGNTDPDGTKTLVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 820460 - protein, 1273 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFLDVSQVENTRHYLQHQRLLFCRDPNHIHGVQSFLKLPPVVNVINLVGAREAQVVIIVHAGDAKAVFLLCRGALDKLVKYVKI

SEQ ID NO: 820461 - protein, 1122 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLGKYLFLFQNISCVISNFELAFN

SEQ ID NO: 820462 - protein, 811 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRREGEGRLVEGRTRGSVSLSQPSCNAWCFLNNKSPFHLSMAESPVREPVGRRRARDWNLHFGTELVEG

SEQ ID NO: 820463 - protein, 680 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQSY

SEQ ID NO: 820464 - protein, 358 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKENIIKRTEDFLCRTELRY

SEQ ID NO: 820465 - protein, 156 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGALCHQWEDLPPEQRGL

SEQ ID NO: 820466 - protein, 205 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGEPRMGASGHSPPGGPGKGQWPAPGEDGGHASQQQMPDLPEKLSPSFTPAHLHPCRRLCEARTLPP

SEQ ID NO: 820467 - protein, 107 aa, Homo sapiens
MLVAAAAERNKDPILHVLRQYLDPAQRGVRVLEVASGSGQHAAHFARAFPLAEWQPSDVDQRCLDRNPEWGLRDTALLEDLGKASGLLLERMVDMPANNKCLIFRKN

SEQ ID NO: 820468 - protein, 107 aa, Homo sapiens; identical to SEQ ID NO: 820467

SEQ ID NO: 820469 - protein, 127 aa, Homo sapiens
MLVAAAAERNKDPILHVLRQYLDPAQRGVRVLEVASGSGQHAAHFARAFPLAEWQPSDVDQRCLDRGSSEQQDTCSNPGPCSSPTGNPEWGLRDTALLEDLGKASGLLLERMVDMPANNKCLIFRKN

SEQ ID NO: 820470 - protein, 156 aa, Homo sapiens; identical to SEQ ID NO: 820465

SEQ ID NO: 820471 - protein, 156 aa, Homo sapiens; identical to SEQ ID NO: 820465

SEQ ID NO: 820472 - protein, 205 aa, Homo sapiens; identical to SEQ ID NO: 820466

SEQ ID NO: 820473 - protein, 161 aa, Homo sapiens [sequence omitted]

SEQ ID NO: 820474 - protein, 191 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGGGGALSFSKPQPASLSQALWEIPRPWSSGLCPHAHALCHQWEDLPPEQRGL

SEQ ID NO: 820475 - protein, 283 aa, Homo sapiens
PASCPRRDPRRVRGGELLLPRCWWRRPRSGTRIPSCTCCGSTWIRPSVASASSRWPRAPASTQRTSRGPSPWPSGSRRTWTSAAWTGAAPGAATSIGAAVRGLKSPRPAAPEEKDAARALRVRGGSLGVPPGQALAVRPPRLRKWVDLGVPLPSRFGLRSSTCPPASPKKFCGGVGKAGAQDSAPTQAFASCSIAATTQAQGLTNVKAPLHLDVTWGWEHWGGILPQSLDLLLCINMAHVSPLRCTEGLFRAAGHLLKPRALLITYGALCHQWEDLPPEQRGL

SEQ ID NO: 820476 - protein, 156 aa, Homo sapiens; identical to SEQ ID NO: 820465

SEQ ID NO: 820477 - protein, 236 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEVCGEPSMGVCRGTTHPAWGQLEMPDLPPSQSGGSSEQQDTCSNPGPCSSPTGPYAINGKISPQSNVDFDLMLRCRNPEWGLRDTALLEDLGKASGLLLERMVDMPANNKCLIFRKN

SEQ ID NO: 820478 - protein, 290 aa, Homo sapiens
PASCPRRDPRRVRGGELLLPRCWWRRPRSGTRIPSCTCCGSTWIRPSVASASSRWPRAPASTQRTSRGPSPWPSGSRRTWTSAAWTGAAPGAATSIGAAVRGLKSPRPAAPEEKDAARALRVRGGSLGVPPGQALAVRPPRLRKWVDLGVPLPSRFGLRSSTCPPASPKKFCGGVGKAGAQDSAPTQAFASCSIAATTQAQGLTNVKAPLHLDVTWGWEHWGGILPQSLDLLLCINMAHVSPLRCTEVCGEPSMGVCRGTTHPAWGQLGCQICPHHSRGEGLQPPPSQSG

SEQ ID NO: 820479 - protein, 318 aa, Homo sapiens
PASCPRRDPRRVRGGELLLPRCWWRRPRSGTRIPSCTCCGSTWIRPSVASASSRWPRAPASTQRTSRGPSPWPSGSRRTWTSAAWTGAAPGAATSIGAAVRGLKSPRPAAPEEKDAARALRVRGGSLGVPPGQALAVRPPRLRKWVDLGVPLPSRFGLRSSTCPPASPKKFCGGVGKAGAQDSAPTQAFASCSIAATTQAQGLTNVKAPLHLDVTWGWEHWGGILPQSLDLLLCINMAHVSPLRCTEGLFRAAGHLLKPRALLITYGGGGALSFSKPQPASLSQALWEIPRPWSSGLCPHAHALCHQWEDLPPEQRGL

SEQ ID NO: 820480 - protein, 196 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGSPQSNVDFDLMLRCRNPEWGLRDTALLEDLGKASGLLLERMVDMPANNKCLIFRKN

SEQ ID NO: 820481 - protein, 194 aa, Homo sapiens
MLVAAAAERNKDPILHVLRQYLDPAQRGVRVLEVASGHSPPGGPGKGQWPAPGEDGGHASQQQMPDLPEKLSPSFSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGALCHQWEDLPPEQRGL

SEQ ID NO: 820482 - protein, 150 aa, Homo sapiens
MLVAAAAERNKDPILHVLRQYLDPAQRGVRVLEVASGSGQHAAHFARAFPLAEWQPSDVDQRCLDRGSSEQQDTCSNPGPCSSPTGPYAINGKISPQSNVDFDLMLRCRNPEWGLRDTALLEDLGKASGLLLERMVDMPANNKCLIFRKN

SEQ ID NO: 820483 - protein, 185 aa, Homo sapiens
MLVAAAAERNKDPILHVLRQYLDPAQRGVRVLEVASGSGQHAAHFARAFPLAEWQPSDVDQRCLDRGSSEQQDTCSNPGPCSSPTGEGVPFHSPNPSLQVCPRLSGKYPDLGPVGCVPMPTPYAINGKISPQSNVDFDLMLRCRNPEWGLRDTALLEDLGKASGLLLERMVDMPANNKCLIFRKN

SEQ ID NO: 820484 - protein, 107 aa, Homo sapiens
PGLVPPTRPAPRPRRGVVAAAMLVAAAAERNKDPILHVLRQYLDPAQRGVRVLEVASGSGQHAAHFARAFPLAEWQPSDVDQRCLDRGSSEQQDTCSNPGPCSSPTG

SEQ ID NO: 820485 - protein, 178 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEVCGEPSMGVCRGTTHPAWGQLGCQICPHHSRGTQNGGFGTQPSWRTWERPVACSWRGW

SEQ ID NO: 820486 - protein, 185 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEEPRMGASGHSPPGGPGKGQWPAPGEDGGHASQQQMPDLPEKLSPSFTPAHLHPCRRLCEARTLPP

SEQ ID NO: 820487 - protein, 290 aa, Homo sapiens; identical to SEQ ID NO: 820478

SEQ ID NO: 820488 - protein, 131 aa, Homo sapiens
ISHRPGQVRRNSPRHCQARKAQLHLGPARMWHKKVDGHRGSSTKFIVSQEGPPMGKHLTRRLWTWDVPYAINGKISPQSNVDFDLMLRCRNPEWGLRDTALLEDLGKASGLLLERMVDMPANNKCLIFRKN

SEQ ID NO: 820489 - protein, 400 aa, Homo sapiens
PASCPRRDPRRVRGGELLLPRCWWRRPRSGTRIPSCTCCGSTWIRPSVASASSRWPRAPASTQRTSRGPSPWPSGSRRTWTSAAWTGAAPGAATSIGAAVRGLKSPRPAAPEEKDAARALRVRGGSLGVPPGQALAVRPPRLRKWVDLGVPLPSRFGLRSSTCPPASPKKFCGGVGKAGAQDSAPTQAFASCSIAATTQAQGLTNVKAPLHLDVTWGWEHWGGILPQSLDLLLCINMAHVSPLRCTEEPRMGASGHSPPGGPGKGQWPAPGEDGGHASQQQMPDLPAVAGPCTRTRPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGLV

SEQ ID NO: 820490 - protein, 135 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEVDMPANNKCLIFRKN

SEQ ID NO: 820491 - protein, 127 aa, Homo sapiens; identical to SEQ ID NO: 820469

SEQ ID NO: 820492 - protein, 136 aa, Homo sapiens
FNTVKGSPTGVVSLGSGDPRFTHWLGQPPRKKKVWPPNNPLLLYVTNAFYGFRGLKTNKGIAPGASLSSMARVSFARSLLMICLWDAPWMRLCGWSQAFPVHRRAWGKFVPLAGSLAVTRFKPNVDDSKEYFSKHN

SEQ ID NO: 820493 - protein, 106 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLGLDQHPPEKREAWAPWEHPPAC

SEQ ID NO: 820494 - protein, 106 aa, Homo sapiens; identical to SEQ ID NO: 820493

SEQ ID NO: 820495 - protein, 106 aa, Homo sapiens; identical to SEQ ID NO: 820493

SEQ ID NO: 820496 - protein, 106 aa, Homo sapiens; identical to SEQ ID NO: 820493

SEQ ID NO: 820497 - protein, 106 aa, Homo sapiens; identical to SEQ ID NO: 820493

SEQ ID NO: 820498 - protein, 265 aa, Homo sapiens
MNTRSAPGGRTPFRLLWPDPDFSAGRLCFPSAIVASFVLAGETEATALQRRPDRPTSRPLLVRASLSPSGLGACDTALRPTRSWGAGGSGWVTRALVRRAGLRQPPGLVDRVPGRVRVSAVASAVLTQSSGPSTQRDLGLGGQSVFPGALTGRGSQLSVMASGNARIGKPAPDFKATAVVDGAFKEVKLSDYKGKYVVLFFYPLDFTFVCPTEIIAFSNRAEDFRKLGCEVLGVSVDSQFTHLGLDQHPPEKREAWAPWEHPPAC

SEQ ID NO: 820499 - protein, 106 aa, Homo sapiens; identical to SEQ ID NO: 820493

SEQ ID NO: 820500 - protein, 129 aa, Homo sapiens
MNTRSAPGGRTPFRLLWPDPDFSAGRLCFPSAIVASFVLAGETEATALQRRPDRPTSRPLLVRASLSPSGLGACDTALRPTRSWGAGGSGWVTRALVRRAGLRQPPGLVDRVPGRVRVSAVASAVLTQS

SEQ ID NO: 820501 - protein, 91 aa, Homo sapiens
PHTGLEVTNKVLGKGEGMRRPWPSPPGPILWSWRGRSGLIIAFSNRAEDFRKLGCEVLGVSVDSQFTHLGLDQHPPEKREAWAPWEHPPAC

SEQ ID NO: 820502 - protein, 106 aa, Homo sapiens; identical to SEQ ID NO: 820493

SEQ ID NO: 820503 - protein, 106 aa, Homo sapiens; identical to SEQ ID NO: 820493

SEQ ID NO: 820504 - protein, 106 aa, Homo sapiens; identical to SEQ ID NO: 820493

SEQ ID NO: 820505 - protein, 129 aa, Homo sapiens; identical to SEQ ID NO: 820500

SEQ ID NO: 820506 - protein, 106 aa, Homo sapiens; identical to SEQ ID NO: 820493

SEQ ID NO: 820507 - protein, 106 aa, Homo sapiens; identical to SEQ ID NO: 820493

SEQ ID NO: 820508 - protein, 106 aa, Homo sapiens; identical to SEQ ID NO: 820493

SEQ ID NO: 820509 - protein, 106 aa, Homo sapiens; identical to SEQ ID NO: 820493

SEQ ID NO: 820510 - protein, 106 aa, Homo sapiens; identical to SEQ ID NO: 820493

SEQ ID NO: 820511 - protein, 106 aa, Homo sapiens; identical to SEQ ID NO: 820493

SEQ ID NO: 820512 - protein, 106 aa, Homo sapiens; identical to SEQ ID NO: 820493

SEQ ID NO: 820513 - protein, 123 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLGLGMSRGQRGRLQLSSHPQVLAVWLRGHCSTSGTCVSPS

SEQ ID NO: 820514 - protein, 106 aa, Homo sapiens; identical to SEQ ID NO: 820493

SEQ ID NO: 820515 - protein, 129 aa, Homo sapiens; identical to SEQ ID NO: 820500

SEQ ID NO: 820516 - protein, 185 aa, Homo sapiens
MRIKEHMLPTGTAKTETHRTAGETRTQREENRENTAQSYICGCHPHRAIAHANKQTGDGASQDERTEDAGRREGARSGTEVGQCDKQEERARADVTRTRRQRQDRRRESEHRREERRRRERQRERKQKKERERATTNAGDGERRDAQREEAPTRRREEQQTRAGRRRAQTEKKTGGGRNGQKRQT

SEQ ID NO: 820517 - protein, 243 aa, Homo sapiens
MAHCNLKFLGSRDPPASASRVAGTTAFQRAVQNAPCPLLFHRGTPAISVCVLPHPADLAEGCSRCQEDPSLIVGSTRGWLRFLPHPITEACTHLPPGHSLTRVEITSATEGLTPCHFKMGTFQAHICHQLFMDGHKKLLNPIPVTWPTKNAAPARTNTDSDSHNKRQDLQKNRHTQHARRAQIVNRGRIKAQPQEEQPTRKQRKKTERGKKPGETHGLRSHLSLGYVAPDDGEDNKRGARAES

SEQ ID NO: 820518 - protein, 506 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYRYYEVKFVKFILNKQFRTVKKKKKKLETSSLISPRTLTLAPEPGAASRLIGGPRGRPPQRTTPGFPPGSAVETLPSPFLTPSPSFPPSFPPVAVSSGAAAPGGAPGTAMGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLRMMVGVNISDEQLGSIADRTIQEADQDGDSAISFTEFVKVLEKVDVEQKMSIRFLH

SEQ ID NO: 820519 - protein, 636 aa, Homo sapiens
MAHLMMFRDVAVDFSQEEWECLDLEQRDLYRDVMLENYSTWSHWVFAFISQKRFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAFISGSDHTQHQLIHTSEKFCGDKECGNTFLPDSEVIQYQTVHTVKKTYECKECGKSFSLRSSLTGHKRIHTGEKPFKCKDCGKAFRFHSQLSVHKRIHTGEKSYECKECGKAFSCGSDLTRHQRIHTGEKPYECNECRKAFSQRSHLIKHQRIHTGEKPYECKECGKAFTRGSHLTQHQRIHTGEKSHECKECGKAFIRGSNLAQHQNVHVGRKPYKCEKCGKAYIWSSHLARHQRIHTGRKPYECKQCGKTFTWASYLAQHEKIHNERKSYECKECGKTFLHGSEFNRHQKIHTGERNYECKECGKTFFRGSELNRHQKIHTGKRPYECEECGKAFLWGSQLTRHQRMHTGEEPYVCKECGKSFIWGSQLTRHKKIHTDAEPYGCKKSSHIFSHHSYFTEQKIHNSANLCEWTDYGNTFSHESNFAQHQNIYTFEKSYEFKDFEKAFSSSSHFISLL

SEQ ID NO: 820520 - protein, 135 aa, Homo sapiens
FTGMWRNQIWLLPLLSWCKKHLAAIKVLFFAVIWYEFATEVNSRSREDFQRIPELAINPLGDRIINAFFPEGEDQVNFRGFMRTLAHFRPIEDNEKSKDVNGPEPLNSRSNKLHFAFRLYDLDKDEKISRDELLQ

SEQ ID NO: 820521 - protein, 231 aa, Homo sapiens
MLLHPFYMFFASFPPSFPPVAVSSGAAAPGGAPGTAMGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLRMMVGVNISDEQLGSIADRTIQEADQDGDSAISFTEFVKVLEKVDVEQKMSIRFLH

SEQ ID NO: 820522 - protein, 204 aa, Homo sapiens [sequence omitted]

SEQ ID NO: 820523 - protein, 231 aa, Homo sapiens; identical to SEQ ID NO: 820521

SEQ ID NO: 820524 - protein, 204 aa, Homo sapiens [sequence omitted]

SEQ ID NO: 820525 - protein, 231 aa, Homo sapiens; identical to SEQ ID NO: 820521

SEQ ID NO: 820526 - protein, 231 aa, Homo sapiens; identical to SEQ ID NO: 820521

SEQ ID NO: 820527 - protein, 231 aa, Homo sapiens; identical to SEQ ID NO: 820521

SEQ ID NO: 820528 - protein, 231 aa, Homo sapiens; identical to SEQ ID NO: 820521

SEQ ID NO: 820529 - protein, 448 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYRYYEVKFVKFILNKQFRTVKKKKKKLETSSLISPRTLTLAPEPGAASRLIGGPRGRPPQRTTPGFPPGSAVETLPSPFLTPSPSFPPSFPPVAVSSGAAAPGGAPGTAMGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQ

SEQ ID NO: 820530 - protein, 466 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYRYYEVKFVKFILNKQFRTVKKKKKKLETSSLISPRTLTLAPEPGAASRLIGGPRGRPPQRTTPGFPPGSAVETLPSPFLTPSPSFPPSFPPVAVSSGAAAPGGAPGTAMGSRASTLLRDEELEEIKKETGFSHSQITRLYSRFTSLDKGENGTLSREDFQRIPELAINPLGDRIINAFFPEGEDQVKMQIFVKTLTGKTITLEVEPSDTIENVKAKIQDKEGIPPGQQRLIFAGKQLEDGRTLSDYNIQKESTLHLVLRLRGG

SEQ ID NO: 820531 - protein, 445 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 820532 - protein, 272 aa, Homo sapiens
MWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 820533 - protein, 476 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQRPLYSLNNCILLKNLLMPDSSPKSMKRFPAKKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 820534 - protein, 260 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMSWFLLEISKIPYLDCWQ

SEQ ID NO: 820535 - protein, 445 aa, Homo sapiens; identical to SEQ ID NO: 820531

SEQ ID NO: 820536 - protein, 445 aa, Homo sapiens; identical to SEQ ID NO: 820531

SEQ ID NO: 820537 - protein, 103 aa, Homo sapiens
FVSRLVPHHSYRSVGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 820538 - protein, 151 aa, Homo sapiens
GCRFGFSGRIPRSQPFPMADPEELQVSSPPPPLPLLPPLQTPLQHLPRAASEFGLASSEQEQRPTVDQLEEVELQIGDGSSGPESFTVYHYNGLKQSNYNEKVMYVEGTAVVMGFEDPMLQTDDTPIKRCLQTKWPYIELLWTTDRSPSLN

SEQ ID NO: 820539 - protein, 342 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPE

SEQ ID NO: 820540 - protein, 180 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSCKIYFYFLKFFSCSFVLMNLLNILKKKLLKIFITCILFQLKLNY

SEQ ID NO: 820541 - protein, 773 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 820542 - protein, 773 aa, Homo sapiens; identical to SEQ ID NO: 820541

SEQ ID NO: 820543 - protein, 773 aa, Homo sapiens; identical to SEQ ID NO: 820541

SEQ ID NO: 820544 - protein, 652 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSLFEVLPHSHWSLSLSCLVLALNWGK

SEQ ID NO: 820545 - protein, 773 aa, Homo sapiens; identical to SEQ ID NO: 820541

SEQ ID NO: 820546 - protein, 773 aa, Homo sapiens; identical to SEQ ID NO: 820541

SEQ ID NO: 820547 - protein, 773 aa, Homo sapiens; identical to SEQ ID NO: 820541

SEQ ID NO: 820548 - protein, 773 aa, Homo sapiens; identical to SEQ ID NO: 820541

SEQ ID NO: 820549 - protein, 779 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSFATCGLLLAFCLVSDRAGPPACARVPWSYHSCHELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 820550 - protein, 648 aa, Homo sapiens
MAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 820551 - protein, 722 aa, Homo sapiens
AEVLKIPEAGLVNVTSQEAKQRSSSPRGYVHYFFGCLDCASHFEQMAAASMHRVGSPNAAVLWLWSSHNRVNARLAGAPSEDPQFPKVQWPPRELLFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 820552 - protein, 496 aa, Homo sapiens
MESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 820553 - protein, 773 aa, Homo sapiens; identical to SEQ ID NO: 820541

SEQ ID NO: 820554 - protein, 773 aa, Homo sapiens; identical to SEQ ID NO: 820541

SEQ ID NO: 820555 - protein, 773 aa, Homo sapiens; identical to SEQ ID NO: 820541

SEQ ID NO: 820556 - protein, 773 aa, Homo sapiens; identical to SEQ ID NO: 820541

SEQ ID NO: 820557 - protein, 644 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSGFRVGFGSFWKSCWSPR

SEQ ID NO: 820558 - protein, 773 aa, Homo sapiens; identical to SEQ ID NO: 820541

SEQ ID NO: 820559 - protein, 773 aa, Homo sapiens; identical to SEQ ID NO: 820541

SEQ ID NO: 820560 - protein, 654 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGRRRWLLSLPPIELCSL

SEQ ID NO: 820561 - protein, 328 aa, Homo sapiens
QSSRGSLAYAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 820562 - protein, 773 aa, Homo sapiens; identical to SEQ ID NO: 820541

SEQ ID NO: 820563 - protein, 207 aa, Homo sapiens
QSSRGSLAYAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSLFEVLPHSHWSLSLSCLVLALNWGK

SEQ ID NO: 820564 - protein, 731 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPSEASRPPKLHPGLRAAPGQEPPEHMAELQRNEQEQPLGQWHLSKRDTGAALLAESRAEKNRLWGPLEVRRVGRSSKQLVDIPWPVSPQSPPSSPVFGHLPVPEHW

SEQ ID NO: 820565 - protein, 532 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRP

SEQ ID NO: 820566 - protein, 561 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPRTTTRTQRPPSTAQINLELYASYVYLSMSYYCDRDEGSSRTPHQ

SEQ ID NO: 820567 - protein, 117 aa, Homo sapiens [sequence omitted]

SEQ ID NO: 820568 - protein, 303 aa, Homo sapiens
GGRRCRGAGTRLIRCLRVVVSAAPRMRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYMSWGCLYSHLAISVHS

SEQ ID NO: 820569 - protein, 106 aa, Homo sapiens [sequence omitted]

SEQ ID NO: 820570 - protein, 503 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 820571 - protein, 503 aa, Homo sapiens; identical to SEQ ID NO: 820570

SEQ ID NO: 820572 - protein, 503 aa, Homo sapiens; identical to SEQ ID NO: 820570

SEQ ID NO: 820573 - protein, 503 aa, Homo sapiens; identical to SEQ ID NO: 820570

SEQ ID NO: 820574 - protein, 503 aa, Homo sapiens; identical to SEQ ID NO: 820570

SEQ ID NO: 820575 - protein, 503 aa, Homo sapiens; identical to SEQ ID NO: 820570

SEQ ID NO: 820576 - protein, 503 aa, Homo sapiens; identical to SEQ ID NO: 820570

SEQ ID NO: 820577 - protein, 503 aa, Homo sapiens; identical to SEQ ID NO: 820570

SEQ ID NO: 820578 - protein, 503 aa, Homo sapiens; identical to SEQ ID NO: 820570

SEQ ID NO: 820579 - protein, 503 aa, Homo sapiens; identical to SEQ ID NO: 820570

SEQ ID NO: 820580 - protein, 503 aa, Homo sapiens; identical to SEQ ID NO: 820570

SEQ ID NO: 820581 - protein, 503 aa, Homo sapiens; identical to SEQ ID NO: 820570

SEQ ID NO: 820582 - protein, 503 aa, Homo sapiens; identical to SEQ ID NO: 820570

SEQ ID NO: 820583 - protein, 503 aa, Homo sapiens; identical to SEQ ID NO: 820570

SEQ ID NO: 820584 - protein, 503 aa, Homo sapiens; identical to SEQ ID NO: 820570

SEQ ID NO: 820585 - protein, 503 aa, Homo sapiens; identical to SEQ ID NO: 820570

SEQ ID NO: 820586 - protein, 503 aa, Homo sapiens; identical to SEQ ID NO: 820570

SEQ ID NO: 820587 - protein, 503 aa, Homo sapiens; identical to SEQ ID NO: 820570

SEQ ID NO: 820588 - protein, 532 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVQVIQLWKIYEYNWIGFFPLCLCCFSWPLSKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 820589 - protein, 383 aa, Homo sapiens
QRRSGIKENSRVPQTLENVVVDNRLALDYLQLDKVGSCAVINKTCCTYIEHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 820590 - protein, 444 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 820591 - protein, 308 aa, Homo sapiens
FQSSGLLLNMMPLDKSAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 820592 - protein, 503 aa, Homo sapiens; identical to SEQ ID NO: 820570

SEQ ID NO: 820593 - protein, 503 aa, Homo sapiens; identical to SEQ ID NO: 820570

SEQ ID NO: 820594 - protein, 503 aa, Homo sapiens; identical to SEQ ID NO: 820570

SEQ ID NO: 820595 - protein, 503 aa, Homo sapiens; identical to SEQ ID NO: 820570

SEQ ID NO: 820596 - protein, 170 aa, Homo sapiens
LRMMKAILVTRSETIPREDIAKDSVLRAYRRYTTCPCNVFMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 820597 - protein, 503 aa, Homo sapiens; identical to SEQ ID NO: 820570

SEQ ID NO: 820598 - protein, 426 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVRALP

SEQ ID NO: 820599 - protein, 347 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGKNLSNK

SEQ ID NO: 820600 - protein, 218 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDGTEIFTLTS

SEQ ID NO: 820601 - protein, 218 aa, Homo sapiens; identical to SEQ ID NO: 820600

SEQ ID NO: 820602 - protein, 288 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGKNLSNK

SEQ ID NO: 820603 - protein, 103 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKRVCS

SEQ ID NO: 820604 - protein, 117 aa, Homo sapiens
MVLEMLNPIHYNITSIVPEAMPAATMPVLLLTGLFLLVWNYEGTSSIPGPGYCMGIGPPIYTPQQNYFEIVIDPEVKAKNDKSKRKQYFHDLGVGKDLLKRTQKTTNRRKNLKIASL

SEQ ID NO: 820605 - protein, 120 aa, Homo sapiens
TVLSTQSGHYGRGSFWRAEHVEANRKVKKNLSYQDGRSCARDLPDVAYVSLNLTEPSTCGIRHSFQVDSVGTELEDTQLVPAAWCVGENPLHLVAEVFCVDDCCRGVRAEGKHCLSVFLK

SEQ ID NO: 820606 - protein, 49 aa, Homo sapiens
MSKLSKNRQYFDFFSSKDLKDAIEVLIAEKRRRISTEEKLEECMDFATE

SEQ ID NO: 820607 - protein, 982 aa, Homo sapiens [sequence omitted]

SEQ ID NO: 820608 - protein, 770 aa, Homo sapiens
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSSLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGTYRI

SEQ ID NO: 820609 - protein, 810 aa, Homo sapiens [sequence omitted]

SEQ ID NO: 820610 - protein, 982 aa, Homo sapiens [sequence omitted]

SEQ ID NO: 820611 - protein, 1012 aa, Homo sapiens
LNATARTAYYLNRARGKSVCAFVLTKLKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSSLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGDVFDSASDPVPLPPARPPTRDNPKHGSSLNRTPSDYDLLIPPLGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 820612 - protein, 938 aa, Homo sapiens
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSSLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 820613 - protein, 241 aa, Homo sapiens [sequence omitted]

SEQ ID NO: 820614 - protein, 222 aa, Homo sapiens
MLLLRTAYYLNRARGKSVCAFVLTKLKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKPPGL

SEQ ID NO: 820615 - protein, 226 aa, Homo sapiens
MLLLRTAYYLNRARGKSVCAFVLTKLKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKHFPHCLGD

SEQ ID NO: 820616 - protein, 141 aa, Homo sapiens
STSALAWAWLLNPSLEFTTPSAPPRPTALTQPPQPESPEFDFLTMNQKMLKPHRTPPAPVTEEMLQRCKYSHMEPPLGGLRFFSTQYKDEFPFKYQGPAALRLKNPQEGFVPLGTPHQRGCREKIDPLVPQPPMYLCPSQQ

SEQ ID NO: 820617 - protein, 125 aa, Homo sapiens
SQSYSNASSRPPWARTTALQSGEFDFLTMNQKMLKPHRTPPAPVTEEMLQRCKYSHMEPPLGGLRFFSTQYKDEFPFKYQGPAALRLKNPQEGFVPLGTPHQRGCREKIDPLVPQPPMYLCPSQQ

SEQ ID NO: 820618 - protein, 625 aa, Homo sapiens
GSAWRGRWAEGAAGGAGGRGASCGPGGSRRPARARRAGQGRGAPGLAPEAAGTSTPEMRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 820619 - protein, 534 aa, Homo sapiens
NEIRARYEARVFAEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 820620 - protein, 625 aa, Homo sapiens; identical to SEQ ID NO: 820618

SEQ ID NO: 820621 - protein, 617 aa, Homo sapiens
GSAWRGRWAEGAAGGAGGRGASCGPGGSRRPARARRAGQGRGAPGLAPEAAGTSTPEMRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDPDPVPSPDPNPVSCPDPCSPTRGTVSPALPTGESPEWVQEQGALLGPDG

SEQ ID NO: 820622 - protein, 302 aa, Homo sapiens
LLKHLRTRRKGPRGGPPKTPGCYPPGPPGCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 820623 - protein, 200 aa, Homo sapiens
GSAWRGRWAEGAAGGAGGRGASCGPGGSRRPARARRAGQGRGAPGLAPEAAGTSTPEMRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLPQPYSCGIF

SEQ ID NO: 820624 - protein, 261 aa, Homo sapiens
EPKLLKRFFKTTMGSDYCPSEWRQVQKAPNLHLQQSNLPRGTGEFDFLTMNQKMLKPHRTPPAPVTEEMLQRVIIPKLVKTVTDAKKQTSTKTSSNTQNICWFVVQERMSSVASGLAPEAAGTSTPEMRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLHMAQKRE

SEQ ID NO: 820625 - protein, 146 aa, Homo sapiens
EPKLLKRFFKTTMGSDYCPSEWRQVQKAPNLHLQQSNLPRGTGEFDFLTMNQKMLKPHRTPPAPVTEEMLQRCKYSHMEPPLGGLRFFSTQYKDEFPFKYQGPAALRLKNPQEGFVPLGTPHQRGCREKIDPLVPQPPMYLCPSQQ

SEQ ID NO: 820626 - protein, 394 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 820627 - protein, 224 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETGEGQHLFDVERIPPGQAKTNNKPRAGKTGDPKTPY

SEQ ID NO: 820628 - protein, 227 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDFSLSTTLEAFWTSDAWYMRKAFRDRCGAQLQRMDFKV

SEQ ID NO: 820629 - protein, 215 aa, Homo sapiens
CLCSVRLRGEVGIFVPCPAIVRAALLATPGRQAPPRFVLKHSSSWRVPFKLFKVKMNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHESNLVFLSPDGGPQTQTRSPL

SEQ ID NO: 820630 - protein, 423 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDTFLFSKPVVIPQLKGGGETWPNNRGVLRDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 820631 - protein, 449 aa, Homo sapiens
CLCSVRLRGEVGIFVPCPAIVRAALLATPGRQAPPRFVLKHSSSWRVPFKLFKVKMNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 820632 - protein, 179 aa, Homo sapiens [sequence omitted]

SEQ ID NO: 820633 - protein, 253 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTGLGLGYEQVFQITTQVVWGRLRLENASFFLSP

SEQ ID NO: 820634 - protein, 75 aa, Homo sapiens
MSKSESPKEPEQLRKLFIGGLSFETTEQTNARIRTRNESPLSERADIPVEETENEFYMSKIHSALDGVDAKEKET

SEQ ID NO: 820635 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 820636 - protein, 320 aa, Homo sapiens; identical to SEQ ID NO: 820635

SEQ ID NO: 820637 - protein, 298 aa, Homo sapiens
MTSLTQRSSGLVQRRTEASRNAADKERAAGGGAGSSEDDAQSRRDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 820638 - protein, 298 aa, Homo sapiens; identical to SEQ ID NO: 820637

SEQ ID NO: 820639 - protein, 384 aa, Homo sapiens
VSRGRHIGKAPPPPPPWSSGCFGDCGHRQEGAPLLPRRRPASPLRPDLFPHDCPRPCCRRTSPRRPDLTRKPGSEAARGGGGRPGRSCDPLGPARRLGGSHDLADPAQLRPGAAAHRGLPQRRRQGAGGGDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 820640 - protein, 280 aa, Homo sapiens
MTSLTQRSSGLVQRRTEASRNAADKERAAGGGAGSSEDDAQSRRDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 820641 - protein, 298 aa, Homo sapiens; identical to SEQ ID NO: 820637

SEQ ID NO: 820642 - protein, 298 aa, Homo sapiens; identical to SEQ ID NO: 820637

SEQ ID NO: 820643 - protein, 298 aa, Homo sapiens; identical to SEQ ID NO: 820637

SEQ ID NO: 820644 - protein, 254 aa, Homo sapiens
MTSLTQRSSGLVQRRTEASRNAADKERAAGGGAGSSEDDAQSRRDEQDDDDKGDSKETRLTLMEEVLLLGLKDREVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 820645 - protein, 182 aa, Homo sapiens
MSTSSSSSWDNLLESLSLSTVWNWIQASFLGETSAPQQTSLGLLDNLAPAVQIILRISFLILLGIGIYALWKRSIQSIQKTLLFVITLYKLYKKGSHIFEALLANPEGSGLRIQDNNNLFLSLGLQEKILKKLKTVENKMKNLEGIIVAQKPATKRDCSSEPYCSCSDCQSPLSTSGFTSPI

SEQ ID NO: 820646 - protein, 182 aa, Homo sapiens; identical to SEQ ID NO: 820645

SEQ ID NO: 820647 - protein, 176 aa, Homo sapiens
MSAGGASVPPPPNPAVSFPPPRVTLPAGPDILRTYSGAFVCLEILFGGLVWILVASSNVPLPLLQGWVMFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 820648 - protein, 176 aa, Homo sapiens; identical to SEQ ID NO: 820647

SEQ ID NO: 820649 - protein, 159 aa, Homo sapiens
MSAGGASVPPPPNPAVSFPPPRVTLPAGPDILRTYSGAFVCLEILFGGLVWILVASSNVPLPLLQGWVMFVSVTAFFFSLLFLGMFLSGMVAQIDANWNFLDFAYHFTVFVFYFGAFLLEAAATSLHDLHCNTTITGQPLLSDNQYNINVAASVSIHIQ

SEQ ID NO: 820650 - protein, 108 aa, Homo sapiens
MFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 820651 - protein, 176 aa, Homo sapiens; identical to SEQ ID NO: 820647

SEQ ID NO: 820652 - protein, 1218 aa, Homo sapiens
MWWSLSSLFLPTEVVLSQGYALLHFHSCSEINSSLAAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIKRGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 820653 - protein, 477 aa, Homo sapiens
MFIHWPVVRLQEMALPPFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 820654 - protein, 261 aa, Homo sapiens
MTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 820655 - protein, 549 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820656 - protein, 613 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820657 - protein, 588 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820658 - protein, 573 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820659 - protein, 613 aa, Homo sapiens; identical to SEQ ID NO: 820656

SEQ ID NO: 820660 - protein, 737 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820661 - protein, 558 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKEPQTTVIHNPVDGIKESSDSANTTIEDEDAKARKQEIIKTTEQLIEAVNNGDFEAYALLAKNSKPIHTTILNPHVHVIGEDAACIAYIRLTQYIDGQGRPRTSQSEETRVWHRRDGKWQNVHFHCSGAPVAPLQ

SEQ ID NO: 820662 - protein, 521 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSARKQEIIKTTEQLIEAVNNGDFEAYAKICDPGLTSFEPEALGNLVEGMDFHRFYFENHLLAKNSKPIHTTILNPHVHVIGEDAACIAYIRLTQYIDGQGRPRTSQSEETRVWHRRDGKWQNVHFHCSGAPVAPLQ

SEQ ID NO: 820663 - protein, 507 aa, Homo sapiens
GCVHYVHSSVLCESEEVGSSKWPACARGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820664 - protein, 413 aa, Homo sapiens
MGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820665 - protein, 613 aa, Homo sapiens; identical to SEQ ID NO: 820656

SEQ ID NO: 820666 - protein, 140 aa, Homo sapiens
MAGQWLARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 820667 - protein, 613 aa, Homo sapiens; identical to SEQ ID NO: 820656

SEQ ID NO: 820668 - protein, 613 aa, Homo sapiens; identical to SEQ ID NO: 820656

SEQ ID NO: 820669 - protein, 109 aa, Homo sapiens
NNQEETNSLDYEKTEQTLIKNKISKRYNLKKPLLAKNSKPIHTTILNPHVHVIGEDAACIAYIRLTQYIDGQGRPRTSQSEETRVWHRRDGKWQNVHFHCSGAPVAPLQ

SEQ ID NO: 820670 - protein, 588 aa, Homo sapiens; identical to SEQ ID NO: 820657

SEQ ID NO: 820671 - protein, 397 aa, Homo sapiens
RRGAARSWRGRSEQISRALAARRSPARPPPGAASRGVSRARARVAAVPASGSRSRRRPSAAERTPSPSAAAMATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKAG

SEQ ID NO: 820672 - protein, 83 aa, Homo sapiens
LLNKKADGVKVRLQPGPVVPGSPEPAASPPRPGAPALESPSPHALRDTGQGMASEGLLPPKSSSSLSPQPQTNSTKNSAAATS

SEQ ID NO: 820673 - protein, 239 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQKKDSCMLM

SEQ ID NO: 820674 - protein, 168 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSQRQEIPEDDSVLFHGRENLLSEQLESLYYGLH

SEQ ID NO: 820675 - protein, 103 aa, Homo sapiens
NLSILNLSILNPLSLISYLNLSILNLSILNLSILNLSILNLSILNLSILNLSILNLSILNLSILNLSSLIRGRWVTAVGGVGGSRGGPGDCLENCTASDEISE

SEQ ID NO: 820676 - protein, 261 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 820677 - protein, 261 aa, Homo sapiens; identical to SEQ ID NO: 820676

SEQ ID NO: 820678 - protein, 240 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRLSVSSYGD

SEQ ID NO: 820679 - protein, 261 aa, Homo sapiens; identical to SEQ ID NO: 820676

SEQ ID NO: 820680 - protein, 222 aa, Homo sapiens
ARVDPAASTRCEKQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 820681 - protein, 234 aa, Homo sapiens
ETDKYTAASVATVASIQVNLEVSKLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 820682 - protein, 206 aa, Homo sapiens
MVILTHMNVNYVQFKVVRMSAHQPQLNSRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 820683 - protein, 218 aa, Homo sapiens
ARRPGRLDTVREDHRPADNPVPRKRLVTKGLDLCPPPPEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 820684 - protein, 261 aa, Homo sapiens; identical to SEQ ID NO: 820676

SEQ ID NO: 820685 - protein, 261 aa, Homo sapiens; identical to SEQ ID NO: 820676

SEQ ID NO: 820686 - protein, 261 aa, Homo sapiens; identical to SEQ ID NO: 820676

SEQ ID NO: 820687 - protein, 261 aa, Homo sapiens; identical to SEQ ID NO: 820676

SEQ ID NO: 820688 - protein, 239 aa, Homo sapiens; identical to SEQ ID NO: 820673

SEQ ID NO: 820689 - protein, 163 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEE

SEQ ID NO: 820690 - protein, 186 aa, Homo sapiens
MDTFSTKSLALQAQKKLLSKMASKAVVAVLVDDTSSEVLDELYRATREFTRSRKEAQKMLKNLVKVALKLGLLLRGDQLGGEELALLRRFRHRARCLAMTAVSFHQVDFTFDRRVLAAGLLECRDLLHQAVGPHLTAKSHGRINHVFGHLADCDFLAALYGPAEPYRSHLRRICEGLGRMLDEGSL

SEQ ID NO: 820691 - protein, 186 aa, Homo sapiens; identical to SEQ ID NO: 820690

SEQ ID NO: 820692 - protein, 186 aa, Homo sapiens; identical to SEQ ID NO: 820690

SEQ ID NO: 820693 - protein, 101 aa, Homo sapiens
KQTTQEPQKERPCRWEGAAHSLQSSLASALHDAQDRPFAPMALYMDRPVNEPCTMDFSKGFKKKFFYNKKQKKRVAELALSLSSTSDDEPPLLPFPFLFLP

SEQ ID NO: 820694 - protein, 435 aa, Homo sapiens
CPQYWTRARRCGWRTRAGLWGNETEGGGGGSGSGGDSVGLTPPPLPGSSLSPLSLTMKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCMKTFSSA

SEQ ID NO: 820695 - protein, 891 aa, Homo sapiens
CPQYWTRARRCGWRTRAGLWGNETEGGGGGSGSGGDSVGLTPPPLPGSSLSPLSLTMKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 820696 - protein, 876 aa, Homo sapiens
MGRGSTLSAEQPCLSSARREDRPFAPMDLYMERPENEPWTMDFSKGFKKKFFYTKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 820697 - protein, 764 aa, Homo sapiens
CPQYWTRARRCGWRTRAGLWGNETEGGGGGSGSGGDSVGLTPPPLPGSSLSPLSLTMKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRSDLGPRVGRVGVGQGSLGGQRPPEVWPLI

SEQ ID NO: 820698 - protein, 342 aa, Homo sapiens
MQIIFFSSSHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 820699 - protein, 891 aa, Homo sapiens; identical to SEQ ID NO: 820695

SEQ ID NO: 820700 - protein, 178 aa, Homo sapiens
ASYSKTIGLGSEAWVCQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 820701 - protein, 882 aa, Homo sapiens
CPQYWTRARRCGWRTRAGLWGNETEGGGGGSGSGGDSVGLTPPPLPGSSLSPLSLTMKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPYYPFPSFFFPNRRYNLLLFVVKWSLPFPLSWPTTQRGGGAGQ

SEQ ID NO: 820702 - protein, 859 aa, Homo sapiens
CPQYWTRARRCGWRTRAGLWGNETEGGGGGSGSGGDSVGLTPPPLPGSSLSPLSLTMKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHLPSLACLSKMD

SEQ ID NO: 820703 - protein, 217 aa, Homo sapiens
CPQYWTRARRCGWRTRAGLWGNETEGGGGGSGSGGDSVGLTPPPLPGSSLSPLSLTMKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEVSVKVRRRWKSHL

SEQ ID NO: 820704 - protein, 68 aa, Homo sapiens
GFSVEGQENLQEILSKQLLLCQFLMALSIVRTGDTSSAVSSPQDPLRGPIGQEHVQGVGGEVKKICLY

SEQ ID NO: 820705 - protein, 2317 aa, Homo sapiens
GGAQRPRWRRLQLRRRAPSLRLGRPRVRAVAVAAAARTMYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQTLDPYNRPWASKTQSEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQLKEEVKKESPTSSSFGKFSWKKPEKEEEKSSLVTPSISKEEILESSKDKEDGKTEAGKAKPIKIKLSGKTVVAHTSPWMPVVTTSTQTKIGPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGASTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINSAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 820706 - protein, 103 aa, Homo sapiens
MRSFVLRAPSLPKAPSQPLSSWISPLLLMSIMMLAITGAKTATPSVGPCLISSLICTIRSTHRGNSKSLQISKRKDCSRHFCPQKGRDRNHRGHGNDGCPCGQ

SEQ ID NO: 820707 - protein, 2472 aa, Homo sapiens
GGAQRPRWRRLQLRRRAPSLRLGRPRVRAVAVAAAARTMYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQVGILLSVIFTPTLTLFKLLYPYLHCKAGKGNILIWQEPQSEEPRDTNKGDTIPRAQSRGLGCNYNTMTSVSEVSASFDSLSTRFFCFILPFSGTCSNMCLPFPQVISIKTVGRGGGGGSWGLLVPWSYYGGKKREKWVIELLVLLCEHLLPLTNRHWIPTTDLGLQRPRVEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQLKEEVKKESPTSSSFGKFSWKKPEKEEEKSSLVTPSISKEEILESSKDKEDGKTEAGKAKPIKIKLSGKTVVAHTSPWMPVVTTSTQTKIGPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGASTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINSAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 820708 - protein, 1155 aa, Homo sapiens
GGAQRPRWRRLQLRRRAPSLRLGRPRVRAVAVAAAARTMYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQGQFQKSSDFQKEGLQQTFLPPERQG

SEQ ID NO: 820709 - protein, 970 aa, Homo sapiens
RRRAAAEVAAAAAAAARSEPASRAPPGQSCRRGRRCKEQCTASSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDHKSTRRKKLQTRLNIRKNKLLDIPSLRTVA

SEQ ID NO: 820710 - protein, 474 aa, Homo sapiens
GGAQRPRWRRLQLRRRAPSLRLGRPRVRAVAVAAAARTMYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQVSAAFLVGPLASLPNILKPAYFPVGYVPNGIFVICAGPTL

SEQ ID NO: 820711 - protein, 84 aa, Homo sapiens
PITKQATRSRPNLRVIPTVTPDKPKQKESLRGSIPAAQVPVQVSIPSLIRYNPEKISDEKNRASQKQKVNISFGYPVPEFSVLP

SEQ ID NO: 820712 - protein, 125 aa, Homo sapiens
GRRASPSPPRGRRVSPSPPRARRGSPSPPRGRRLFPPGPAGFRGSSRGESRADYARDGRGDHPGDSGSRVIPPLVQDSLHPPVPSPGIPVSRNARGLQTRVLSAKPPANSLGDAEPGGFCQTRER

SEQ ID NO: 820713 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSAK

SEQ ID NO: 820714 - protein, 126 aa, Homo sapiens; identical to SEQ ID NO: 820713

SEQ ID NO: 820715 - protein, 126 aa, Homo sapiens; identical to SEQ ID NO: 820713

SEQ ID NO: 820716 - protein, 126 aa, Homo sapiens; identical to SEQ ID NO: 820713

SEQ ID NO: 820717 - protein, 126 aa, Homo sapiens; identical to SEQ ID NO: 820713

SEQ ID NO: 820718 - protein, 131 aa, Homo sapiens
MPEPAKSAPAPKKGSKKAVTKAQKKDGKKRKRSRKESYSVYVYKVLKQVHPDTGISSKAMGIMNSFVNDIFERIAGEASRWPLDLIQIPKRIIYKLISVSLVHSFSLIIIYCSSKNCLHYPSPLLPLRKSI

SEQ ID NO: 820719 - protein, 105 aa, Homo sapiens
PTRDGVQGVASLPSHASLGFGQASLHTKHEPQGGLEEGVSGSSASPGSDLVVVIAQVASKALLSVHSIRTSHLSTPIASGLVPPPSVMSSFTQAAHLRFTFQHLL

SEQ ID NO: 820720 - protein, 717 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 820721 - protein, 717 aa, Homo sapiens; identical to SEQ ID NO: 820720

SEQ ID NO: 820722 - protein, 739 aa, Homo sapiens
WRLDLNSKEWIRPLASAVEWNVMASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 820723 - protein, 663 aa, Homo sapiens
MIKTGNRHSFNNLMDKLSVWTEGFALSVLGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 820724 - protein, 758 aa, Homo sapiens
MASSSDSEDDSFMAVDQEETVLEGTMDQDEEPHPVLEAEETRHNRSMSELPEEVLEYILSFLSPYQEHKTAALVCKQWYRLIKDGTSLHHPGWSSVAQSQLIATSTSWVQGILLLPPPKYAGITGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 820725 - protein, 678 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 820726 - protein, 717 aa, Homo sapiens; identical to SEQ ID NO: 820720

SEQ ID NO: 820727 - protein, 717 aa, Homo sapiens; identical to SEQ ID NO: 820720

SEQ ID NO: 820728 - protein, 717 aa, Homo sapiens; identical to SEQ ID NO: 820720

SEQ ID NO: 820729 - protein, 435 aa, Homo sapiens [sequence omitted]

SEQ ID NO: 820730 - protein, 435 aa, Homo sapiens [sequence omitted]

SEQ ID NO: 820731 - protein, 524 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIVPKCWQTPIPEYELQAHADVRAGH

SEQ ID NO: 820732 - protein, 717 aa, Homo sapiens; identical to SEQ ID NO: 820720

SEQ ID NO: 820733 - protein, 717 aa, Homo sapiens; identical to SEQ ID NO: 820720

SEQ ID NO: 820734 - protein, 122 aa, Homo sapiens
PTRDGVQGVASLPSHASLGFGQASLHTKHEPQGGLEEGVSGSSASPGSDLVVVIAQVASKALLSVHSIRTSHLSTPIASGLVPPPSVMSSFTQAAHLRFTFQHLLNSCFSLPLNGPQLLLLA

SEQ ID NO: 820735 - protein, 546 aa, Homo sapiens
MTKVCREISPVRKRHGGRRAGGKDTLVSVPRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVERYDTITNQWEAVAPLPKAVHSAAATVCGGKIYVFGGVNEAGRAAGVLQSYVPQTNTWSFIESPMIDNKYAPAVTLNGFVFILGGAYARATTIYDPEKGNIKAGPNMNHSRQFCSAVVLDGKIYATGGIVSSEGPALGNMEAYEPTTNTWTLLPHMPCPVFRHGCVVIKKYIQSG

SEQ ID NO: 820736 - protein, 676 aa, Homo sapiens
MPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVERYDTITNQWEAVAPLPKAVHSAAATVCGGKIYVFGGVNEAGRAAGVLQSYVPQTNTWSFIESPMIDNKYAPAVTLNGFVFILGGAYARATTIYDPEKGNIKAGPNMNHSRQFCSAVVLDGKIYATGGIVSSEGPALGNMEAYEPTTNTWTLLPHMPCPVFRHGCVVIKKYIQSG

SEQ ID NO: 820737 - protein, 228 aa, Homo sapiens
MPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPRGKSCCHVPPHGPASAPPCAVTATPPGQGVLHASSFTGLPNPEAAVEPPPAQDNWPEMGEGGGRCGGRDKQSGKMRRGKKRKEGRACKAQSPSPSSPSPGHSHLQPPRPGQAAKG

SEQ ID NO: 820738 - protein, 165 aa, Homo sapiens
GRGRCCRSRRRRRRLDESRAAPLIAAQADRQEDRLPSPGHPPWAAGTRRRRRRRRNEGRRRRAGTRGGGPGSVSSGQDPSGPSHRYPPALSALHQPSCAHPRPRALCASGRGRSRAPETIWLPGDAHALLSVGGHRGFRILGTNPELARDGRRKVRALFPCEKPP

SEQ ID NO: 820739 - protein, 625 aa, Homo sapiens
SEAITSLVASSASAVTTKAPGISKGDSQSQGLATSIRWGQTPINQSTPWDTDEPPSKQMRESDNPGTGPWVTTVAAGNQPTLIAHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVER

SEQ ID NO: 820740 - protein, 256 aa, Homo sapiens
CTDAAIGRKSPLMFQRKAERASLDETPGGLECLIAVPPTAGVISGYAGHAEGEEQMAVAALACDLCPAQGPSWPWALFLLSCRYDTITNQWEAVAPLPKAVHSAAATVCGGKIYVFGGVNEAGRAAGVLQSYVPQTNTWSFIESPMIDNKYAPAVTLNGFVFILGGAYARATTIYDPEKGNIKAGPNMNHSRQFCSAVVLDGKIYATGGIVSSEGPALGNMEAYEPTTNTWTLLPHMPCPVFRHGCVVIKKYIQSG

SEQ ID NO: 820741 - protein, 372 aa, Homo sapiens
SEAITSLVASSASAVTTKAPGISKGDSQSQGLATSIRWGQTPINQSTPWDTDEPPSKQMRESDNPGTGPWVTTVAAGNQPTLIAHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLGEPGGHICRLGGRVQMGGVGLQ

SEQ ID NO: 820742 - protein, 337 aa, Homo sapiens
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820743 - protein, 168 aa, Homo sapiens
MFACSWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820744 - protein, 179 aa, Homo sapiens
ERGVGGYILSQPAAASWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820745 - protein, 117 aa, Homo sapiens
GRVGLSPYRLGDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820746 - protein, 344 aa, Homo sapiens
YRLGSEAWVRAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820747 - protein, 328 aa, Homo sapiens
YRLGSEAWVRAAPQLGKRKRELDVEEAHAASTEEKEAGVGNGTCAPVRLPFSGFRLQKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820748 - protein, 418 aa, Homo sapiens
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNGDTLAMSGDILGCHNLGRVLTNIPTEATGMQLNILQCTGQPLQQNYPGQNVSGAEIEKPWIKHHSTYVVFTVCQTFFKNFTDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820749 - protein, 264 aa, Homo sapiens
MQLNILQCTGQPLQQNYPGQNVSGAEIEKPWIKHHSTYVVFTVCQTFFKNFTDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820750 - protein, 249 aa, Homo sapiens
LLSDLEDPTSHGWLHHSLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820751 - protein, 337 aa, Homo sapiens; identical to SEQ ID NO: 820742

SEQ ID NO: 820752 - protein, 179 aa, Homo sapiens
QNTATPGGGSAPTTLSWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 820753 - protein, 154 aa, Homo sapiens
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTSTPATWSTPASRTPSSWSGGSCTDS

SEQ ID NO: 820754 - protein, 38 aa, Homo sapiens
MGLNPSHAVLVLLSTGSRAPPGPTLKQPRLLEEGPDER

SEQ ID NO: 820755 - protein, 633 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 820756 - protein, 633 aa, Homo sapiens; identical to SEQ ID NO: 820755

SEQ ID NO: 820757 - protein, 291 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPSTPPHQATPAQVPSLDAERSHSSS

SEQ ID NO: 820758 - protein, 380 aa, Homo sapiens
MTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 820759 - protein, 435 aa, Homo sapiens
IEGWDSSSRTGCNHDGRISFDEYWTLIGGITGPSAKLIHEQEQQSSSKRPLWPHLPGTGLMPRPGALPRAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 820760 - protein, 306 aa, Homo sapiens
ETESRCPPGWSAVASSRLTAGSAPRVHAILLPHPPEELGVQAPARVAKLIVDRGVSEGCWVRLSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 820761 - protein, 147 aa, Homo sapiens
MIELGTVRSSESDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 820762 - protein, 633 aa, Homo sapiens; identical to SEQ ID NO: 820755

SEQ ID NO: 820763 - protein, 633 aa, Homo sapiens; identical to SEQ ID NO: 820755

SEQ ID NO: 820764 - protein, 633 aa, Homo sapiens; identical to SEQ ID NO: 820755

SEQ ID NO: 820765 - protein, 633 aa, Homo sapiens; identical to SEQ ID NO: 820755

SEQ ID NO: 820766 - protein, 633 aa, Homo sapiens; identical to SEQ ID NO: 820755

SEQ ID NO: 820767 - protein, 633 aa, Homo sapiens; identical to SEQ ID NO: 820755

SEQ ID NO: 820768 - protein, 633 aa, Homo sapiens; identical to SEQ ID NO: 820755

SEQ ID NO: 820769 - protein, 633 aa, Homo sapiens; identical to SEQ ID NO: 820755

SEQ ID NO: 820770 - protein, 633 aa, Homo sapiens; identical to SEQ ID NO: 820755

SEQ ID NO: 820771 - protein, 633 aa, Homo sapiens; identical to SEQ ID NO: 820755

SEQ ID NO: 820772 - protein, 621 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSAHGVRANC

SEQ ID NO: 820773 - protein, 553 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSWPEMGSSRSPQ

SEQ ID NO: 820774 - protein, 565 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPACLAPPSERAALLS

SEQ ID NO: 820775 - protein, 548 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSCLRFVLACDRPGLR

SEQ ID NO: 820776 - protein, 269 aa, Homo sapiens
PQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLLPLADAYVFRYMPSTPQPPLVAPID

SEQ ID NO: 820777 - protein, 83 aa, Homo sapiens
FNAFFKILCFELGVMNNSFVDLCPQNTVSFFSLQVVTYDGASTIVDWFMPLYDHGVFGNGCGKWCTWRAWFFVGILSYNWIRL

SEQ ID NO: 820778 - protein, 1544 aa, Homo sapiens
RHGRQHRVPVLFRLAPESFGSARRWTHERVPPWSLTTAEQTATEGRNSEPSSGPRQETYRQERQTHHGLHQCREPAPENHPRLARSVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLQERMQQLDRENQELRAAVSQQGEQLQTERERGRTAAEDNVRLTCLVAELQKQWEVTQATQNTVKELQTCLQALELGAAEKEEDYHTALRRLESMLQPLAQELEATRDSLDKKNQHLASFPGWLAMAQQKADTASDTKGRQEPIPSDAAQEMQELGEKLQALERERTKVEEVNRQQSAQLEQLVKELQLKEDARASLERLVKEMAPLQEELSGKGQEADQLWRRLQELLAHTSSWEEELAELRREKKQQQEEKELLEQEVRSLTRQLQFLETQLAQVSQHVSDLEEQKKQLIQDKDHLSQQVGMLERLAGPPGPELPVAGEKNEALVPVNSSLQEAWGKPEEEQRGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 820779 - protein, 1544 aa, Homo sapiens; identical to SEQ ID NO: 820778

SEQ ID NO: 820780 - protein, 915 aa, Homo sapiens
RHGRQHRVPVLFRLAPESFGSARRWTHERVPPWSLTTAEQTATEGRNSEPSSGPRQETYRQERQTHHGLHQCREPAPENHPRLARSVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLQERMQQLDRENQELRAAVSQQGEQLQTERERGRTAAEDNVRLTCLVAELQKQWEVTQATQNTVKELQTCLQALELGAAEKEEDYHTALRRLESMLQPLAQELEATRDSLDKKNQHLASFPGWLAMAQQKADTASDTKGRQEPIPSDAAQEMQELGEKLQALERERTKVEEVNRQQSAQLEQLVKELQLKEDARASLERLVKEMAPLQEELSGAQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 820781 - protein, 1072 aa, Homo sapiens
YRGIITKGLSDRRKDPLGDAQLEQLVKELQLKEDARASLERLVKEMAPLQEELSGKGQEADQLWRRLQELLAHTSSWEEELAELRREKKQQQEEKELLEQEVRSLTRQLQFLETQLAQVSQHVSDLEEQKKQLIQDKDHLSQQVGMLERLAGPPGPELPVAGEKNEALVPVNSSLQEAWGKPEEEQRGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 820782 - protein, 910 aa, Homo sapiens
RFRVLQLCFLGAAFGLGQLLLQLPVGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 820783 - protein, 502 aa, Homo sapiens
RHGRQHRVPVLFRLAPESFGSARRWTHERVPPWSLTTAEQTATEGRNSEPSSGPRQETYRQERQTHHGLHQCREPAPENHPRLARSVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLQERMQQLDRENQELRAAVSQQGEQLQTERERGRTAAEDNVRLTCLVAELQKQWEVTQATQNTVKELQTCLQALELGAAEKEEDYHTALRRLESMLQPLAQELEATRDSLDKKNQHLASFPGWLAMLISLNNSYVFISIPDAFFIMPLKPLTTFKNMPTSVRFTYPQTRRHVWHKVLSSRSKWTLQSA

SEQ ID NO: 820784 - protein, 1544 aa, Homo sapiens; identical to SEQ ID NO: 820778

SEQ ID NO: 820785 - protein, 501 aa, Homo sapiens
RHGRQHRVPVLFRLAPESFGSARRWTHERVPPWSLTTAEQTATEGRNSEPSSGPRQETYRQERQTHHGLHQCREPAPENHPRLARSVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLQERMQQLDRENQELRAAVSQQGEQLQTERERGRTAAEDNVRLTCLVAELQKQWEVTQATQNTVKELQTCLQALELGAAEKEEDYHTALRRLESMLQPLAQELEATRDSLDKKNQHLASFPGWLAMGPACWRLSWVHWPCPVNPRAVTPSGTPGKRRYTAIMRVGARGPPGDPDQLLQSCSCPSLPQ

SEQ ID NO: 820786 - protein, 803 aa, Homo sapiens
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLPTVTAKEDEEED

SEQ ID NO: 820787 - protein, 803 aa, Homo sapiens; identical to SEQ ID NO: 820786

SEQ ID NO: 820788 - protein, 912 aa, Homo sapiens
RWACLLLLLLPPHRLFFFNLERGGEWEPERKQNIKKPQRQPAGARCPMASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLPTVTAKEDEEED

SEQ ID NO: 820789 - protein, 801 aa, Homo sapiens
MKEKAMIKTAKMQGNVMELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLPTVTAKEDEEED

SEQ ID NO: 820790 - protein, 107 aa, Homo sapiens
PTTDIRGSGRLRAWGWLGSLKEDVASQERSRQKGQRALPTERMAAPVTWCPKQLEDEEPCWGRDTGVCSCCHVCVFQPNSSNDNIQSITSGDWDVTKILAYDEKGNK

SEQ ID NO: 820791 - protein, 90 aa, Homo sapiens
MTGRPLRVPRQCRFFISQISEARRLAVSPLAPAPGSRVVSRAGVGGPLASVVRGSCQAAHAVFGVSREYYITMVKWATSTKVAVTWLNRA

SEQ ID NO: 820792 - protein, 268 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820793 - protein, 227 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRVSVGLWESSGRTLDDFLTFPRHVFRVMILPPPGGSTVLPVTPLSPHRLPAVFSSSQNEDITEPQSILA

SEQ ID NO: 820794 - protein, 237 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820795 - protein, 190 aa, Homo sapiens
MKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820796 - protein, 257 aa, Homo sapiens
MDTATVYYTGRLLNYVGVATICEKELLLPLLFRSLQHGAPAAHRILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820797 - protein, 190 aa, Homo sapiens; identical to SEQ ID NO: 820795

SEQ ID NO: 820798 - protein, 235 aa, Homo sapiens
HHCTPAWATRAKQQEKKKEAALCPKPTSRSPNLGPLGLFSLSVPNLLLAGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820799 - protein, 191 aa, Homo sapiens
MRTRMMAGRIVQRQDKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820800 - protein, 324 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRVSVGLWESSGRTLDDFLTFPRHVFRVMILPPPGGSTVLPVTPLSPHRLPAVFSSSQNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820801 - protein, 268 aa, Homo sapiens; identical to SEQ ID NO: 820792

SEQ ID NO: 820802 - protein, 138 aa, Homo sapiens
MRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820803 - protein, 268 aa, Homo sapiens; identical to SEQ ID NO: 820792

SEQ ID NO: 820804 - protein, 194 aa, Homo sapiens
MRFLTAVNLEHPEMLEKASRELWMRVWSRVSVGLWESSGRTLDDFLTFPRHVFRVMILPPPGGSTVLPVTPLSPHRLPAVFSSSQNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820805 - protein, 181 aa, Homo sapiens
MLEKASRELWMRVWSRVSVGLWESSGRTLDDFLTFPRHVFRVMILPPPGGSTVLPVTPLSPHRLPAVFSSSQNEDITEPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820806 - protein, 138 aa, Homo sapiens; identical to SEQ ID NO: 820802

SEQ ID NO: 820807 - protein, 256 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820808 - protein, 269 aa, Homo sapiens
MGPLPRTVELFYDVLSPYSWLGFEILCRYQNIWNINLQLRPSLITGIMKDSGNKPPGLLPRKGLYMANDFKKAFPPLEKEPNPNSSQGISPNSNFPKGIPVSVMLENRTVVSVPLVGARFFILLHAARDTWTHPEYAGESVPGAVDCASGQGMNDISPGKGPPGQRKPIPGLAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820809 - protein, 119 aa, Homo sapiens
MGWWVTCDSGVPTDFAPQSILAAAEKAGMSAEQAQGLLEKIATPKVKNQLKETTEAACRYGAFGLPITVAHVDGQTHMLFGSDRMEAAGAPAGREVDGPYTSSRECQTLRLPGGSKLFV

SEQ ID NO: 820810 - protein, 227 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGVSSSLCVFPAPILKMET

SEQ ID NO: 820811 - protein, 249 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIAAFGLPITVAHVDGQTHMLFGSDRMEAAGAPAGREVDGPYTSSRECQTLRLPGGSKLFV

SEQ ID NO: 820812 - protein, 283 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRVSVGLWESSGRTLDDFLTFPRHVFRVMILPPPGGSTVLPVTPLSPHRLPAVFSSSQNEDITEPQSILAAAEKAGMSAEQAQGLLEKIATPKVKNQLKETTEAACRYGVSSSLCVFPAPILKMET

SEQ ID NO: 820813 - protein, 227 aa, Homo sapiens; identical to SEQ ID NO: 820810

SEQ ID NO: 820814 - protein, 227 aa, Homo sapiens; identical to SEQ ID NO: 820810

SEQ ID NO: 820815 - protein, 227 aa, Homo sapiens; identical to SEQ ID NO: 820810

SEQ ID NO: 820816 - protein, 227 aa, Homo sapiens; identical to SEQ ID NO: 820810

SEQ ID NO: 820817 - protein, 182 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAVSVLAPPQLHS

SEQ ID NO: 820818 - protein, 238 aa, Homo sapiens
GRSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRVSVGLWESSGRTLDDFLTFPRHVFRVMILPPPGGSTVLPVTPLSPHRLPAVFSSSQNEDITEPQSILAVSVLAPPQLHS

SEQ ID NO: 820819 - protein, 73 aa, Homo sapiens
SGHGDRVLYRQVTELVGVATSEKRSSCCHCSSGACSMGPLPRTVELFYDVLSPYSWLGFEVTLGGVASAVSGE

SEQ ID NO: 820820 - protein, 2011 aa, Homo sapiens
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNTGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGDLIHLPPYLRMDFLLNRGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 820821 - protein, 1952 aa, Homo sapiens
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNTGNAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGDLIHLPPYLRMDFLLNRGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 820822 - protein, 2011 aa, Homo sapiens; identical to SEQ ID NO: 820820

SEQ ID NO: 820823 - protein, 1794 aa, Homo sapiens
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNTGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTE

SEQ ID NO: 820824 - protein, 411 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 820825 - protein, 411 aa, Homo sapiens; identical to SEQ ID NO: 820824

SEQ ID NO: 820826 - protein, 411 aa, Homo sapiens; identical to SEQ ID NO: 820824

SEQ ID NO: 820827 - protein, 411 aa, Homo sapiens; identical to SEQ ID NO: 820824

SEQ ID NO: 820828 - protein, 123 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYPSWPLLPCAQPHRRC

SEQ ID NO: 820829 - protein, 354 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKVMKMFWNYSTYGCLSFCTNNTWLLPPDWSLSGIQR

SEQ ID NO: 820830 - protein, 207 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVSHSAPCL

SEQ ID NO: 820831 - protein, 123 aa, Homo sapiens; identical to SEQ ID NO: 820828

SEQ ID NO: 820832 - protein, 130 aa, Homo sapiens
MYVCVCVCARTCIFSSPFLNPGLMKNVPCVPPATIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTR

SEQ ID NO: 820833 - protein, 1785 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITKMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 820834 - protein, 1785 aa, Homo sapiens; identical to SEQ ID NO: 820833

SEQ ID NO: 820835 - protein, 1722 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNMPGDDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITKMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 820836 - protein, 1730 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITKMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKSLT

SEQ ID NO: 820837 - protein, 742 aa, Homo sapiens
TPSSASQSAEITGVSHHTRSNVYFVWNYLPRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 820838 - protein, 205 aa, Homo sapiens [sequence omitted]

SEQ ID NO: 820839 - protein, 249 aa, Homo sapiens
LSSNIDQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 820840 - protein, 1552 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITKMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYATSSSSVWSSWN

SEQ ID NO: 820841 - protein, 282 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTG

SEQ ID NO: 820842 - protein, 397 aa, Homo sapiens [sequence omitted]

SEQ ID NO: 820843 - protein, 30 aa, Homo sapiens
MYKYMSSQHLFKLLDCLQESHSFSKAFNSN

SEQ ID NO: 820844 - protein, 221 aa, Homo sapiens
PPPQADWRFCGGSSGGQPGRRVTWPTASRATSRGPQGMDLQAAGAQAQGAAEPSRGPPLPSARGAPPSPEAGFATADHSGQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 820845 - protein, 77 aa, Homo sapiens
YYYYKFCGRSDELKADQGNPYDADDIQESISQELKPWVCCAPQGDMIYDPSWHHPPPLIPYYSKMVFETGQFDDAED

SEQ ID NO: 820846 - protein, 221 aa, Homo sapiens; identical to SEQ ID NO: 820844

SEQ ID NO: 820847 - protein, 80 aa, Homo sapiens
RPGRGAAGLRGGESRGRGWALRVSRDGCPPAGRRCGFGKWEVTLVTESRGPLPGAWARARLALLQLTTPVRRERLRKCLQ

SEQ ID NO: 820848 - protein, 242 aa, Homo sapiens
KDKTNDLGTTRTRRIHKVGQKARLENRRPVTITGLKYEPGWRFRQRRASRATSRGPQGMDLQAAGAQAQGAAEPSRGPPLPSARGAPPSPEAGFATADHSGQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 820849 - protein, 221 aa, Homo sapiens; identical to SEQ ID NO: 820844

SEQ ID NO: 820850 - protein, 221 aa, Homo sapiens; identical to SEQ ID NO: 820844

SEQ ID NO: 820851 - protein, 221 aa, Homo sapiens; identical to SEQ ID NO: 820844

SEQ ID NO: 820852 - protein, 172 aa, Homo sapiens [sequence omitted]

SEQ ID NO: 820853 - protein, 270 aa, Homo sapiens
PPPQADWRFCGGSSGGQPGRRVTWPTASRATSRGPQGMDLQAAGAQAQGAAEPSRGPPLPSARGAPPSPEAGFATADHSGQERETEKAMDRLASPLCCLVAFSAQLNSNLLWKPCLELLKGSPELFLCSNPSFYREKQLENARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 820854 - protein, 221 aa, Homo sapiens; identical to SEQ ID NO: 820844

SEQ ID NO: 820855 - protein, 172 aa, Homo sapiens [sequence omitted]

SEQ ID NO: 820856 - protein, 117 aa, Homo sapiens
MKRVEEIKQKRQAKLYNGTQMLTRTHTLTRATESSGYQQKSTQNIHLIRAPLLQATRGTPVLAHGRTHWSQAKFTNEDLWHPLGKRCSFKNKSPGLNPFFFFYCYHLLDTQLAPCVH

SEQ ID NO: 820857 - protein, 117 aa, Homo sapiens; identical to SEQ ID NO: 820856

SEQ ID NO: 820858 - protein, 117 aa, Homo sapiens; identical to SEQ ID NO: 820856

SEQ ID NO: 820859 - protein, 117 aa, Homo sapiens; identical to SEQ ID NO: 820856

SEQ ID NO: 820860 - protein, 101 aa, Homo sapiens
STGINAEWPLRPGSSQAWRLFGGVTRGFNMRIEKCYFCSGPIYPGHGMMFVRNDVQGVQICANLNVIKTLKRSAILAKLGGPKHSGKQLVKSLQWIIHCEL

SEQ ID NO: 820861 - protein, 117 aa, Homo sapiens; identical to SEQ ID NO: 820856

SEQ ID NO: 820862 - protein, 117 aa, Homo sapiens; identical to SEQ ID NO: 820856

SEQ ID NO: 820863 - protein, 117 aa, Homo sapiens; identical to SEQ ID NO: 820856

SEQ ID NO: 820864 - protein, 117 aa, Homo sapiens; identical to SEQ ID NO: 820856

SEQ ID NO: 820865 - protein, 117 aa, Homo sapiens; identical to SEQ ID NO: 820856

SEQ ID NO: 820866 - protein, 120 aa, Homo sapiens
ALSPPFTPIPSPRTSAEREKFDPLETRVLDLELADPPGCRNSDERGFNMRIEKCYFCSGPIYPGHGMMFVRNDVQGVQICANLNVIKTLKRSAILAKLGGPKHSGKQLVKSLQWIIHCEL

SEQ ID NO: 820867 - protein, 117 aa, Homo sapiens; identical to SEQ ID NO: 820856

SEQ ID NO: 820868 - protein, 117 aa, Homo sapiens; identical to SEQ ID NO: 820856

SEQ ID NO: 820869 - protein, 117 aa, Homo sapiens; identical to SEQ ID NO: 820856

SEQ ID NO: 820870 - protein, 117 aa, Homo sapiens
MKRVEEIKQKRQAKLYNGTQMLTRTHTLTRATESSGYQQKSTQNIHLIRAPLLQATRGTPVLAHGRTHWSQAKFTNEDLWHPLGKRCSFKNKSPGLNPFFFFYCYHLLDTQLAPCVD

SEQ ID NO: 820871 - protein, 86 aa, Homo sapiens
STGINAEWPLRPGSSQAWRLFGGVTRGFNMRIEKCYFCSGPIYPGHGMMFVRNDVQVKKKRNPRKVRWTKAFRKAAGKELTVDNSL

SEQ ID NO: 820872 - protein, 117 aa, Homo sapiens; identical to SEQ ID NO: 820856

SEQ ID NO: 820873 - protein, 117 aa, Homo sapiens; identical to SEQ ID NO: 820870

SEQ ID NO: 820874 - protein, 117 aa, Homo sapiens; identical to SEQ ID NO: 820856

SEQ ID NO: 820875 - protein, 136 aa, Homo sapiens
MRIPSRELEYALIMTYAYRYCKIMTLIMITSESYGIKLCDAMKRVEEIKQKRQAKLYNGTQMLTRTHTLTRATESSGYQQKSTQNIHLIRAPLLQATRGTPVLAHGRTHWSQAKFTNEDLWHPLGKRCSFKNKSPG

SEQ ID NO: 820876 - protein, 115 aa, Homo sapiens
MVAKIILEVHKVLYTEQFEEPEELETVPREISQIVMQRDTQSGFDHPLARRRATLSDDTLVRPSLPTRTCGTHLGKDAPLKTNLLGETHFSFFIVTIFWTHNWPLVWINCGKNLA

SEQ ID NO: 820877 - protein, 155 aa, Homo sapiens
MKRVEEIKQKRQAKLYNGTQHRGHASKQSKQLKQSQASSKAQSSQKTIPNFFNSKPPPFPFWPSAKRGGTTTTTKGGVSLCGGGGQQHTKAEQQHQGGDYTRHTKPTSCWGGGSYHTTPNIVGPHNKGGVSSHNTPKIYMSAERTGGGDNHLFGA

SEQ ID NO: 820878 - protein, 103 aa, Homo sapiens
METTNGTETWYESLHAVLKALNATLHSNLLCRPGPGLGPDNQTEERRASLPGRDDNSYMYILFVMFLFAVTVGSLILGYTRSRKVDKRSDPYHVYIKNRVSMI

SEQ ID NO: 820879 - protein, 103 aa, Homo sapiens; identical to SEQ ID NO: 820878

SEQ ID NO: 820880 - protein, 103 aa, Homo sapiens; identical to SEQ ID NO: 820878

SEQ ID NO: 820881 - protein, 103 aa, Homo sapiens; identical to SEQ ID NO: 820878

SEQ ID NO: 820882 - protein, 1092 aa, Homo sapiens
MMDSPKIGNGLPVIGPGTDIGISSLHMVGYLGKNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 820883 - protein, 121 aa, Homo sapiens
PNPATHTWRAQQPPAPPLLVAAVATASAATGRTATPLRRATGSAHVFTFPATPPSFQAQRAAGRRTLLPRTQAGSRLPSGDASGGGAVRGERGLNVATRVEIKLEQEFRSTRYQEGECPRQ

SEQ ID NO: 820884 - protein, 1092 aa, Homo sapiens; identical to SEQ ID NO: 820882

SEQ ID NO: 820885 - protein, 1086 aa, Homo sapiens
MMDSPKIGNGLPVIGPGTDIGISSLHMNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 820886 - protein, 1180 aa, Homo sapiens
PNPATHTWRAQQPPAPPLLVAAVATASAATGRTATPLRRATGSAHVFTFPATPPSFQAQRAAGRRTLLPRTQAGSRLPSGDASGGGAVRGERGLNVATRVEIKLEQEFRSTRYQEGECPRQNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 820887 - protein, 763 aa, Homo sapiens
MESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 820888 - protein, 172 aa, Homo sapiens
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 820889 - protein, 107 aa, Homo sapiens [sequence omitted]

SEQ ID NO: 820890 - protein, 107 aa, Homo sapiens [sequence omitted]

SEQ ID NO: 820891 - protein, 130 aa, Homo sapiens
MSSSGGAPGASASSAPPAQEEGMTWWYRWLCRLSGVLGAVSCAISGLFNCITIHPLNIAAGVWMMMAVVPIVISLTLTTLLGNAIAFATGVLYGLSALGKKGDAISYARIQQQRQQADEEKLAETLEGEL

SEQ ID NO: 820892 - protein, 148 aa, Homo sapiens
AGGQMLTAAGSTAELSACAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 820893 - protein, 172 aa, Homo sapiens; identical to SEQ ID NO: 820888

SEQ ID NO: 820894 - protein, 69 aa, Homo sapiens
MAVVPIVISLTLTTLLGNAIAFATGVLYGLSALGKKCVCQAQPWAGPSSLRPPKSFSEEDLRVPLLASG

SEQ ID NO: 820895 - protein, 505 aa, Homo sapiens
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 820896 - protein, 522 aa, Homo sapiens
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 820897 - protein, 505 aa, Homo sapiens; identical to SEQ ID NO: 820895

SEQ ID NO: 820898 - protein, 505 aa, Homo sapiens; identical to SEQ ID NO: 820895

SEQ ID NO: 820899 - protein, 519 aa, Homo sapiens
IPLDVELSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 820900 - protein, 505 aa, Homo sapiens; identical to SEQ ID NO: 820895

SEQ ID NO: 820901 - protein, 358 aa, Homo sapiens
MTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 820902 - protein, 528 aa, Homo sapiens
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEVSLLYFFLYSFTKLCIFQNNEKVDFKCSHHKERISI

SEQ ID NO: 820903 - protein, 352 aa, Homo sapiens
MESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 820904 - protein, 470 aa, Homo sapiens [sequence omitted]

SEQ ID NO: 820905 - protein, 262 aa, Homo sapiens
VALEVPDGIETGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 820906 - protein, 360 aa, Homo sapiens [sequence omitted]

SEQ ID NO: 820907 - protein, 166 aa, Homo sapiens
LCGYPRNLLLSHMVLQLKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 820908 - protein, 512 aa, Homo sapiens
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 820909 - protein, 318 aa, Homo sapiens
MFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 820910 - protein, 175 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 820911 - protein, 110 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRDGRKLKRI

SEQ ID NO: 820912 - protein, 174 aa, Homo sapiens
IYLLIWLFICGTFNAPVMVGEDIEARRHFLNLCCQPRRVSLRLKKCISEVKDKAGSAQCHPLEQRAGIPSGEWRQLKERSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 820913 - protein, 115 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVSNLGRIHLNIPQRS

SEQ ID NO: 820914 - protein, 175 aa, Homo sapiens; identical to SEQ ID NO: 820910

SEQ ID NO: 820915 - protein, 175 aa, Homo sapiens; identical to SEQ ID NO: 820910

SEQ ID NO: 820916 - protein, 175 aa, Homo sapiens; identical to SEQ ID NO: 820910

SEQ ID NO: 820917 - protein, 175 aa, Homo sapiens; identical to SEQ ID NO: 820910

SEQ ID NO: 820918 - protein, 175 aa, Homo sapiens; identical to SEQ ID NO: 820910

SEQ ID NO: 820919 - protein, 104 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRFP

SEQ ID NO: 820920 - protein, 174 aa, Homo sapiens; identical to SEQ ID NO: 820912

SEQ ID NO: 820921 - protein, 104 aa, Homo sapiens; identical to SEQ ID NO: 820919

SEQ ID NO: 820922 - protein, 106 aa, Homo sapiens
MAQSQGWVKRYIKAFCKGFFVAVPVAVTFLDRVACVARVEGASMQPSLNPGGSQSSDVVLLNHWKVRNFEVHRGDIVSLVNTYIAKQTVLSIARGFVQSWLTSVVS

SEQ ID NO: 820923 - protein, 1052 aa, Homo sapiens
MEGSEPVAAHQGEEASCSSWGTGSTNKNLPIMSTASVEIDDALYSRQRYVLGDTAMQKMAKSHVFLSGMGGLGLEIAKNLVLAGIKAVTIHDTEKCQAWDLGTNFFLSEDDVVNKRNRAEAVLKHIAELNPYVHVTSSSVPFNETTDLSFLDKYQCVVLTEMKLPLQKKINDFCRSQCPPIKFISADVHGIWSRLFCDFGDEFEVLDTTGEEPKEIFISNITQANPGIVTCLENHPHKLETGQFLTFREINGMTGLNGSIQQITVISPFSFSIGDTTELEPYLHGGIAVQVKTPKTVFFESLERQLKHPKCLIVDFSNPEAPLEIHTAMLALDQFQEKYSRKPNVGCQQDSEELLKLATSISETLEEKPDVNADIVHWLSWTAQGFLSPLAAAVGGVASQEVLKAVTGKFSPLCQWLYLEAADIVESLGKPECEEFLPRGDRYDALRACIGDTLCQKLQNLNIFLVGCGAIGCEMLKNFALLGVGTSKEKGMITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQKIQSGHSLEGCFQVIKLLSRRPRNWSQCVELARLKFEKYFNHKALQLLHCFPLDIRLKDGSLFWQSPKRPPSPIKFDLNEPLHLSFLQNAAKLYATVYCIPFAEEDLSADALLNILSEVKIQEFKPSNKVVQTDETARKPDHVPISSEDERNAIFQLEKAILSNEATKSDLQMAVLSFEKDDDHNGHIDFITAASNLRAKMYSIEPADRFKTKRIAGKIIPAIATTTATVSGLVALEMIKVTGGYPFEAYKNCFLNLAIPIVVFTETTEVRKTKIRNGISFTIWDRWTVHGKEDFTLLDFINAVKEKYGIEPTMVVQGVKMLYVPVMPGHAKRLKLTMHKLVKPTTEKKYVDLTVSFAPDIDGDEDLPGPPVRYYFSHDTD

SEQ ID NO: 820924 - protein, 1052 aa, Homo sapiens; identical to SEQ ID NO: 820923

SEQ ID NO: 820925 - protein, 1052 aa, Homo sapiens; identical to SEQ ID NO: 820923

SEQ ID NO: 820926 - protein, 1059 aa, Homo sapiens
MEGSEPVAAHQGEEASCSSWGTGSTNKNLPIMSTASVEIDDALYSRQRYVLGDTAMQKMAKSHVFLSGMGGLGLEIAKNLVLAGIKAVTIHDTEKCQAWDLGTNFFLSEDDVVNKRNRAEAVLKHIAELNPYVHVTSSSVPFNETTDLSFLDKYQCVVLTEMKLPLQKKINDFCRSQCPPIKFISADVHGIWSRLFCDFGDEFEVLDTTGEEPKEIFISNITQANPGIVTCLENHPHKLETGQFLTFREINGMTGLNGSIQQITVISPFSFSIGDTTELEPYLHGGIAVQVKTPKTVFFESLERQLKHPKCLIVDFSNPEAPLEIHTAMLALDQFQEKYSRKPNVGCQQDSEELLKLATSISETLEEKPDVNADIVHWLSWTAQGFLSPLAAAVGGVASQEVLKAVTGKFSPLCQWLYLEAADIVESLGKPECEEFLPRGDRYDALRACIGDTLCQKLQNLNIFLVGCGAIGCEMLKNFALLGVGTSKEKGMPYFLDIEITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQKIQSGHSLEGCFQVIKLLSRRPRNWSQCVELARLKFEKYFNHKALQLLHCFPLDIRLKDGSLFWQSPKRPPSPIKFDLNEPLHLSFLQNAAKLYATVYCIPFAEEDLSADALLNILSEVKIQEFKPSNKVVQTDETARKPDHVPISSEDERNAIFQLEKAILSNEATKSDLQMAVLSFEKDDDHNGHIDFITAASNLRAKMYSIEPADRFKTKRIAGKIIPAIATTTATVSGLVALEMIKVTGGYPFEAYKNCFLNLAIPIVVFTETTEVRKTKIRNGISFTIWDRWTVHGKEDFTLLDFINAVKEKYGIEPTMVVQGVKMLYVPVMPGHAKRLKLTMHKLVKPTTEKKYVDLTVSFAPDIDGDEDLPGPPVRYYFSHDTD

SEQ ID NO: 820927 - protein, 1052 aa, Homo sapiens; identical to SEQ ID NO: 820923

SEQ ID NO: 820928 - protein, 730 aa, Homo sapiens
LWQLRKLKLGCSVLSCRCQQDSEELLKLATSISETLEEKPDVNADIVHWLSWTAQGFLSPLAAAVGGVASQEVLKAVTGKFSPLCQWLYLEAADIVESLGKPECEEFLPRGDRYDALRACIGDTLCQKLQNLNIFLVGCGAIGCEMLKNFALLGVGTSKEKGMPYFLDIEITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQKIQSGHSLEGCFQVIKLLSRRPRNWSQCVELARLKFEKYFNHKALQLLHCFPLDIRLKDGSLFWQSPKRPPSPIKFDLNEPLHLSFLQNAAKLYATVYCIPFAEEDLSADALLNILSEVKIQEFKPSNKVVQTDETARKPDHVPISSEDERNAIFQLEKAILSNEATKSDLQMAVLSFEKDDDHNGHIDFITAASNLRAKMYSIEPADRFKTKRIAGKIIPAIATTTATVSGLVALEMIKVTGGYPFEAYKNCFLNLAIPIVVFTETTEVRKTKIRNGISFTIWDRWTVHGKEDFTLLDFINAVKEKYGIEPTMVVQGVKMLYVPVMPGHAKRLKLTMHKLVKPTTEKKYVDLTVSFAPDIDGDEDLPGPPVRYYFSHDTD

SEQ ID NO: 820929 - protein, 1052 aa, Homo sapiens; identical to SEQ ID NO: 820923

SEQ ID NO: 820930 - protein, 62 aa, Homo sapiens
MTLVGVSLGVSYKAAVKVLAGPAVILRLDWGRICFPSWLMWFLVGFSSSCIVKLRTSVPAGS

SEQ ID NO: 820931 - protein, 346 aa, Homo sapiens [sequence omitted]

SEQ ID NO: 820932 - protein, 285 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820933 - protein, 285 aa, Homo sapiens; identical to SEQ ID NO: 820932

SEQ ID NO: 820934 - protein, 274 aa, Homo sapiens
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820935 - protein, 274 aa, Homo sapiens; identical to SEQ ID NO: 820934

SEQ ID NO: 820936 - protein, 172 aa, Homo sapiens
AGPGLRVARLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820937 - protein, 290 aa, Homo sapiens
GATKIQNRDARYLKQRRSTIRLGTAGAIGRGNKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGSTPCPKGCLGPVPARVSLSGLICFP

SEQ ID NO: 820938 - protein, 230 aa, Homo sapiens
TLRARYEAWVVLLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820939 - protein, 307 aa, Homo sapiens
GATKIQNRDARYLKQRRSTIRLGTAGAIGRGNKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820940 - protein, 285 aa, Homo sapiens; identical to SEQ ID NO: 820932

SEQ ID NO: 820941 - protein, 285 aa, Homo sapiens; identical to SEQ ID NO: 820932

SEQ ID NO: 820942 - protein, 285 aa, Homo sapiens; identical to SEQ ID NO: 820932

SEQ ID NO: 820943 - protein, 285 aa, Homo sapiens; identical to SEQ ID NO: 820932

SEQ ID NO: 820944 - protein, 285 aa, Homo sapiens; identical to SEQ ID NO: 820932

SEQ ID NO: 820945 - protein, 285 aa, Homo sapiens; identical to SEQ ID NO: 820932

SEQ ID NO: 820946 - protein, 289 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGLNEYDAYPNEVAYFN

SEQ ID NO: 820947 - protein, 273 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMIR

SEQ ID NO: 820948 - protein, 290 aa, Homo sapiens
MAFLWADTENHVVVVTVYVIPGERLGRVDWAGSPSKFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820949 - protein, 246 aa, Homo sapiens
SLVPPGWISSTHALCTRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820950 - protein, 268 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGSTPCPKGCLGPVPARVSLSGLICFP

SEQ ID NO: 820951 - protein, 243 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTG

SEQ ID NO: 820952 - protein, 243 aa, Homo sapiens; identical to SEQ ID NO: 820951

SEQ ID NO: 820953 - protein, 359 aa, Homo sapiens
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVSVIQRTGEWFPSREGSPLFFIPFDGMGGLVAAGDWKSCWRWAICVCNKVFGIRCKMGEGVVTSFGDGWRPRLNSPPFSHNQFLLRIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYPRMPVLTTGFKSPLVTEKGVEIEGPLSTETNWDIAHMISGFELKYRCIIQN

SEQ ID NO: 820954 - protein, 226 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEAPPNFN

SEQ ID NO: 820955 - protein, 220 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQVSSKSRGGGKGRQKEMD

SEQ ID NO: 820956 - protein, 178 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGERFI

SEQ ID NO: 820957 - protein, 220 aa, Homo sapiens; identical to SEQ ID NO: 820955

SEQ ID NO: 820958 - protein, 178 aa, Homo sapiens; identical to SEQ ID NO: 820956

SEQ ID NO: 820959 - protein, 178 aa, Homo sapiens; identical to SEQ ID NO: 820956

SEQ ID NO: 820960 - protein, 220 aa, Homo sapiens; identical to SEQ ID NO: 820955

SEQ ID NO: 820961 - protein, 220 aa, Homo sapiens; identical to SEQ ID NO: 820955

SEQ ID NO: 820962 - protein, 220 aa, Homo sapiens; identical to SEQ ID NO: 820955

SEQ ID NO: 820963 - protein, 220 aa, Homo sapiens; identical to SEQ ID NO: 820955

SEQ ID NO: 820964 - protein, 127 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMV

SEQ ID NO: 820965 - protein, 189 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVTRMYTGAE

SEQ ID NO: 820966 - protein, 188 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVATLLFGG

SEQ ID NO: 820967 - protein, 185 aa, Homo sapiens
SAFIFSATVTKMEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESILAPDIAFL

SEQ ID NO: 820968 - protein, 544 aa, Homo sapiens [sequence omitted]

SEQ ID NO: 820969 - protein, 552 aa, Homo sapiens
MGYLEELLGVGPQVEEFSVEPPLDDLSLDEAQFVLAPSCCSVDSAGPRPEVEEENGEEVFLSAYDDLSPLLGPKPPIWKGSGSLEGEAAGCGRQALGQGGEEQACWEVGEDKQAEPGGRLDIREEAEGSPETKVEAGKASEDRGEAGGSQETKVRLREGSREETEAKEEKSKGQKKADSMEAKGVEEPGGDEYTDEKEKEIEREEDEQREEAQVEAGRDLEQGAQEDQVAEEKWEVVQKQEAEGVREDEDKGQREKGYHEARKDQGDGEDSRSPEAATEGGAGEVSKERESGDGEAEGDQRAGGYYLEEDTLSEGSGVASLEVDCAKEGNPHSSEMEEVAPQPPQPEEMEPEGQPSPDGCLCPCSLGLGGVGMRLASTLVQVQQVRSVPVVPPKPQFAKMPSAMCSKIHVAPANPCPRPGRLDGTPGERAWGSRASRSSWRNGGSLSFDAAVALARDRQRTEAQGVRRTQTCTEGGDYCLIPRTSPCSMISAHSPRPLSCLELPSEGAEGSGSRSRLSLPPREPQVPDPLLSSQRRSYAFETQANPGKGEGL

SEQ ID NO: 820970 - protein, 582 aa, Homo sapiens
CGCKDALTGSGLRSCTASCPLKLSGARRASARLGHETQDTISCQGPGSFLFNSHFRVAGAPGAGAAARCPGHPPPPIGSPAPLGPGQAQQLAGIPWGTGRAQVLGDRGDRASALGLLAMKSRQKGKKKGSAKERVFGCDLQEHLQHSGQEVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGP

SEQ ID NO: 820971 - protein, 586 aa, Homo sapiens
CGCKDALTGSGLRSCTASCPLKLSGARRASARLGHETQDTISCQGPGSFLFNSHFRVAGAPGAGAAARCPGHPPPPIGSPAPLGPGQAQQLAGIPWGTGRAQVLGDRGDRASALGLLAMKSRQKGKKKGSAKERVFGCDLQEHLQHSGQEVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPLPPVTMCKRGPVQISLGSPFSFGITCSYFRKGKWCHSGPGTASPARLGPQVPL

SEQ ID NO: 820972 - protein, 468 aa, Homo sapiens
MSFARRGLPKFHFSDPVQSLTTQSSDFYVSAPSVSPVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGP

SEQ ID NO: 820973 - protein, 236 aa, Homo sapiens
MLCLQVEEFSVEPPLDDLSLDEAQFVLAPSCCSVDSAGPRPEVEEENGEEVFLSAYDDLSPLLGPKPPIWKGSGSLEGEAAGCGRQALGQGGEEQACWEVGEDKQAEPGGRLDIREEAEGSPETKVEAGKASEDRGEAGGSQETKVRLREGSREETEAKEEKSKGQKKADSMEAKGVEEPGGDEYTDEKEKEIEREEDEQREEAQVEAGRDLEQGAQEDQVAEAGKSLEPGRQRLQ

SEQ ID NO: 820974 - protein, 645 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820975 - protein, 172 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEDICRQGQTEISRSP

SEQ ID NO: 820976 - protein, 103 aa, Homo sapiens
MRPRKAFLLLLLLGLVQLLAVAGAEGPDEDSSNRENAIEDEEEEEEEDDDEEEDDLEVKEEKVCLDPDELYFDKSEDFRGAPGPEFAYSKVFTYAKRGVAEKG

SEQ ID NO: 820977 - protein, 92 aa, Homo sapiens
MRPRKAFLLLLLLGLVQLLAVAGAEGPDEDFRQVQANSRRTRPGSGKGEGEPLERRGEGVKKQVRVLWNSKHSFSVILLTEKTTCKSRALAS

SEQ ID NO: 820978 - protein, 645 aa, Homo sapiens; identical to SEQ ID NO: 820974

SEQ ID NO: 820979 - protein, 673 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEDGVFLCLPGWSVQWCNLGSPNSLHLRGSEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820980 - protein, 492 aa, Homo sapiens
MPPQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820981 - protein, 453 aa, Homo sapiens
TEETIGAFEQVYRCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820982 - protein, 537 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820983 - protein, 607 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPPDGKKKPRGGRGFFFF

SEQ ID NO: 820984 - protein, 605 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANEVSPRPGSTPRGRPPLF

SEQ ID NO: 820985 - protein, 375 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYESLITRVQEVPKLKVCALRVTSRAQRILRAGGKILTFDQLALDSPKGCGTVLLSGPRKGREVYRHFGKPRNPHSTQTYVVQGRSRACRGEGSGVKKYPDLSF

SEQ ID NO: 820986 - protein, 356 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEDGVFLCLPGWSVQWCNLGSPNSLHLRGSEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGEISNLTHFSPVAVL

SEQ ID NO: 820987 - protein, 197 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEDGVLLLWPRLQYDGAISAHRNLHLPDSSDSPASASRVAV

SEQ ID NO: 820988 - protein, 645 aa, Homo sapiens; identical to SEQ ID NO: 820974

SEQ ID NO: 820989 - protein, 162 aa, Homo sapiens
MRPRKAFLLLLLLGLVQLLAVAGAEGPDEDFRQVQANSRRTRPGSGKGEGEPLERRGEGVKKQVRVLWNSKHSFSVILLTEPVSFPAIPSPHLSLLPPSLPSLLSPPSTPYSPISPTFLSALPHLFSLHYPPPPPLTPILTPLSPRPLPLIHPPPLLLLSSS

SEQ ID NO: 820990 - protein, 645 aa, Homo sapiens; identical to SEQ ID NO: 820974

SEQ ID NO: 820991 - protein, 632 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820992 - protein, 580 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGRPQRPL

SEQ ID NO: 820993 - protein, 442 aa, Homo sapiens
EVTLISLHLFAEFSPAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820994 - protein, 288 aa, Homo sapiens
MQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820995 - protein, 169 aa, Homo sapiens
DSSRISHRFAGMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 820996 - protein, 269 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFSWAVVVIRPLV

SEQ ID NO: 820997 - protein, 325 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEDGVFLCLPGWSVQWCNLGSPNSLHLRGSEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGDSDPEAGPGVPEGWRRCHHHRGL

SEQ ID NO: 820998 - protein, 767 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 820999 - protein, 767 aa, Homo sapiens; identical to SEQ ID NO: 820998

SEQ ID NO: 821000 - protein, 313 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFWRLSQMYELTDLLGELQGARQHQGKDLGARGLGLARRGLTTGAPGRGPQATGENKHTRNENARKDRRIKSGNGTREGGSPTP

SEQ ID NO: 821001 - protein, 142 aa, Homo sapiens
PAPRGCPLNAPSSCSCSRSRDPEASEWHWCYFGRKTSRELKIAGAIGPCVSLNVKGPCVSENELGVGGTSQWKICGLDPTSTLGIYMEVVKQHHTPIPQGGRGAIQFVTHYQHSSSQRRIRVTTIARKSLVLVARVSGKSVA

SEQ ID NO: 821002 - protein, 767 aa, Homo sapiens; identical to SEQ ID NO: 820998

SEQ ID NO: 821003 - protein, 767 aa, Homo sapiens; identical to SEQ ID NO: 820998

SEQ ID NO: 821004 - protein, 767 aa, Homo sapiens; identical to SEQ ID NO: 820998

SEQ ID NO: 821005 - protein, 767 aa, Homo sapiens; identical to SEQ ID NO: 820998

SEQ ID NO: 821006 - protein, 767 aa, Homo sapiens; identical to SEQ ID NO: 820998

SEQ ID NO: 821007 - protein, 767 aa, Homo sapiens; identical to SEQ ID NO: 820998

SEQ ID NO: 821008 - protein, 738 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 821009 - protein, 653 aa, Homo sapiens
PAPRGCPLNAPSSCSCSRSRDPEASEWHWCYFGRKTSRELKIAGAIGPCVSLNVKGPCVSENELGVGGTSQWKICGLDPTSTLGIYMEVVKQHHTPIPQGGRGAIQFVTHYQHSSTFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 821010 - protein, 767 aa, Homo sapiens; identical to SEQ ID NO: 820998

SEQ ID NO: 821011 - protein, 456 aa, Homo sapiens
PAPRGCPLNAPSSCSCSRSRDPEASEWHWCYFGRKTSRELKIAGAIGPCVSLNVKGPCVSENELGVGGTSQWKICGLDPTSTLGIYMEVVKQHHTPIPQGGRGAIQFVTHISTPAPETHPRDHHRPKELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 821012 - protein, 739 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQLLQMVHEHLQANIISYGVDAAAN

SEQ ID NO: 821013 - protein, 185 aa, Homo sapiens
MFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 821014 - protein, 333 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKAL

SEQ ID NO: 821015 - protein, 370 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHSVMLSNRAHVQMYTTFIYARAPYHTRVLEMSVCTITLG

SEQ ID NO: 821016 - protein, 332 aa, Homo sapiens
PAPRGCPLNAPSSCSCSRSRDPEASEWHWCYFGRKTSRELKIAGAIGPCVSLNVKGPCVSENELGVGGTSQWKICGLDPTSTLGIYMEVVKQHHTPIPQGGRGAIQFVTHYQHSSSQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEQEILQARFPMPRYINTEHGGSQARFLLSKVNPSQTHNNLYAWGQETGAPILTDDVSLQVFMDHLKKLAVSSAC

SEQ ID NO: 821017 - protein, 258 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRTLHTCVKGCGRGGSEADLLNEYPCSAGQ

SEQ ID NO: 821018 - protein, 129 aa, Homo sapiens [sequence omitted]

SEQ ID NO: 821019 - protein, 665 aa, Homo sapiens [sequence omitted]

SEQ ID NO: 821020 - protein, 165 aa, Homo sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQVLSTLRMRYRC

SEQ ID NO: 821021 - protein, 830 aa, Homo sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQSLLRSSYHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 821022 - protein, 594 aa, Homo sapiens
MENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 821023 - protein, 526 aa, Homo sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGSLQLLKLTVESMCEMASTISSGLKLRTGDNSINSIECG

SEQ ID NO: 821024 - protein, 823 aa, Homo sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 821025 - protein, 823 aa, Homo sapiens; identical to SEQ ID NO: 821024

SEQ ID NO: 821026 - protein, 823 aa, Homo sapiens; identical to SEQ ID NO: 821024

SEQ ID NO: 821027 - protein, 823 aa, Homo sapiens; identical to SEQ ID NO: 821024

SEQ ID NO: 821028 - protein, 229 aa, Homo sapiens
TLEVPHSRIHQEGRDKDTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGIV

SEQ ID NO: 821029 - protein, 103 aa, Homo sapiens
MVSPFAKPSWMKPKEIMRKSWWLFVEETKHSLDGLKQASRMRDASIKLILVLTGGRGLLWLWVLGLVLEAFFNSESVLLPSTELEGAKDGASSSSELSVELSS

SEQ ID NO: 821030 - protein, 100 aa, Homo sapiens
SRGYPLDASVTDHSAYLQETGKPLDETLKKALTGHLEEVVLALLKTPAQFDADELRAAMKGLGTDEDTLIEILASRTNKEIRETLCIQRTLCIQRGSSRL

SEQ ID NO: 821031 - protein, 220 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGPCIEAGETENRGQT

SEQ ID NO: 821032 - protein, 220 aa, Homo sapiens; identical to SEQ ID NO: 821031

SEQ ID NO: 821033 - protein, 220 aa, Homo sapiens; identical to SEQ ID NO: 821031

SEQ ID NO: 821034 - protein, 220 aa, Homo sapiens; identical to SEQ ID NO: 821031

SEQ ID NO: 821035 - protein, 220 aa, Homo sapiens; identical to SEQ ID NO: 821031

SEQ ID NO: 821036 - protein, 220 aa, Homo sapiens; identical to SEQ ID NO: 821031

SEQ ID NO: 821037 - protein, 220 aa, Homo sapiens; identical to SEQ ID NO: 821031

SEQ ID NO: 821038 - protein, 220 aa, Homo sapiens; identical to SEQ ID NO: 821031

SEQ ID NO: 821039 - protein, 220 aa, Homo sapiens; identical to SEQ ID NO: 821031

SEQ ID NO: 821040 - protein, 220 aa, Homo sapiens; identical to SEQ ID NO: 821031

SEQ ID NO: 821041 - protein, 220 aa, Homo sapiens; identical to SEQ ID NO: 821031

SEQ ID NO: 821042 - protein, 220 aa, Homo sapiens; identical to SEQ ID NO: 821031

SEQ ID NO: 821043 - protein, 220 aa, Homo sapiens; identical to SEQ ID NO: 821031

SEQ ID NO: 821044 - protein, 220 aa, Homo sapiens; identical to SEQ ID NO: 821031

SEQ ID NO: 821045 - protein, 220 aa, Homo sapiens; identical to SEQ ID NO: 821031

SEQ ID NO: 821046 - protein, 220 aa, Homo sapiens; identical to SEQ ID NO: 821031

SEQ ID NO: 821047 - protein, 220 aa, Homo sapiens; identical to SEQ ID NO: 821031

SEQ ID NO: 821048 - protein, 220 aa, Homo sapiens; identical to SEQ ID NO: 821031

SEQ ID NO: 821049 - protein, 220 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGCELKTWAGFRCQGPCIEAGETENRGQT

SEQ ID NO: 821050 - protein, 241 aa, Homo sapiens
TLEVPHSRIHQEGRDKDTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGPCIEAGETENRGQT

SEQ ID NO: 821051 - protein, 231 aa, Homo sapiens
MNLILRYTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGPCIEAGETENRGQT

SEQ ID NO: 821052 - protein, 218 aa, Homo sapiens
MVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGCELKTWAEFRCQGPCIEAGETENRGQT

SEQ ID NO: 821053 - protein, 234 aa, Homo sapiens
ECEIFKKKEIFSFSFFGQAKRRALNDHPKCSIRSQQLVMKGEQIVNVSLKCRDQREPIYSSSRMSLLHRHMLSVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGPCIEAGETENRGQT

SEQ ID NO: 821054 - protein, 154 aa, Homo sapiens
LDAKCPLDAKRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGPCIEAGETENRGQT

SEQ ID NO: 821055 - protein, 220 aa, Homo sapiens; identical to SEQ ID NO: 821031

SEQ ID NO: 821056 - protein, 220 aa, Homo sapiens; identical to SEQ ID NO: 821031

SEQ ID NO: 821057 - protein, 203 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALGLGTDEDTLIEILASRTNKEIRDINRVYREELKRDLAKDITSDTSGDFRNALLSLAKGDRSEDFWCELKTWAGFRCQGPCIEAGETENRGQT

SEQ ID NO: 821058 - protein, 68 aa, Homo sapiens
QEPHQEPHEEPHDEPRKVPHEEPHQDHTKSGSWGDRSEDFGCELKTWAEFRCQGPCIEAGETENRGQT

SEQ ID NO: 821059 - protein, 271 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGFVMKQKKVAEEKSERKTEKSPQNDAKEKVALEILTGADDPEGGRSFYFYDKSHVSCPILYGILFI

SEQ ID NO: 821060 - protein, 206 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQG

SEQ ID NO: 821061 - protein, 208 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFWCELKTWAGFRCQGIV

SEQ ID NO: 821062 - protein, 126 aa, Homo sapiens
REKGRHSSAHTTFTRTPLPQRFATPPPAPCASTESGLEESDMTHPPQLRERATANQLSAREAHHAHGGVGTRHKALIRIMVSRSEIDMNDIKAFYQKMYGISLCQAILDETKGDYEKILVALCGGN

SEQ ID NO: 821063 - protein, 200 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKVQLRYFRKCLLFYKD

SEQ ID NO: 821064 - protein, 216 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTLHPETLCIQRHFASRDTLDPEDTLHPETLCIQRTLCIQRGSSRL

SEQ ID NO: 821065 - protein, 176 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDFGSRGHFASRDTLHPEDTLHPEGIL

SEQ ID NO: 821066 - protein, 150 aa, Homo sapiens
LDAKCPLDAKRQQIKAAYLQETGKPLDETLKKALTGHLEEVVLALLKTPAQFDADELRAAMKGLGTDEDTLIEILASRTNKEIRDINRVYREELKRDLAKDITSDTLHPETLCIQRHFASRDTLDPEDTLHPETLCIQRTLCIQRGSSRL

SEQ ID NO: 821067 - protein, 147 aa, Homo sapiens
REVVAPSVWAVPWLEVTVRRRLRRRLWWRRWRLRRRPRRRRRKQKMADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 821068 - protein, 147 aa, Homo sapiens; identical to SEQ ID NO: 821067

SEQ ID NO: 821069 - protein, 147 aa, Homo sapiens; identical to SEQ ID NO: 821067

SEQ ID NO: 821070 - protein, 102 aa, Homo sapiens
MADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 821071 - protein, 147 aa, Homo sapiens; identical to SEQ ID NO: 821067

SEQ ID NO: 821072 - protein, 128 aa, Homo sapiens
VRVSRRLREARGRGEQRLRRRRRKKKMADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 821073 - protein, 131 aa, Homo sapiens
NSIPGRRFHLLDSWPVAVNLQRRRRRKKKMADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 821074 - protein, 110 aa, Homo sapiens
VAASVLRSKNMGLLEISGVGGTEFQPQKDLPGQCQGRSLGRGGVCDFLYLSSLVIVTEKTNILLRYLHQQWDKKNAAKKRDQEQVELEGESSAPPRKVARTDSPDMHEDT

SEQ ID NO: 821075 - protein, 152 aa, Homo sapiens
REVVAPSVWAVPWLEVTVRRRLRRRLWWRRWRLRRRPRRRRRKQKMADFLKGLPVYNKSNFSRFHADSVCKASNRRPSVYLPTREYPSEQIIVTEKTNILLRYLHQQWDKKLPARWRGPTAQTCTRTLKTLNSTGASCQVCSSVAHPPARHV

SEQ ID NO: 821076 - protein, 117 aa, Homo sapiens
SPFKKSAIFCFLRRRLAAASAMGQKERCQEERPGASGAGRRELRTSPQGGADRQPRHARGHLRLSTPQAPPARSAPRSPTRLPAMCKHPARPPPCRPIHTLRPHHFQPHRSRCIYFP

SEQ ID NO: 821077 - protein, 78 aa, Homo sapiens
VCAFSALAIFLLRLVPLLLRFVLFLLAFVLVLPRLVCSLRFFLMSSWFVVVLSPRVCAHLVQLIFPLLSVRVQSLVVH

SEQ ID NO: 821078 - protein, 279 aa, Homo sapiens
ISRCVRETQARSSLDLLHPPRQFFFFKSKSLDFLKLLNWMRLLKSELGSFITDYFQNQLLAKGLFFVEEKIKLCEGENRIEVLAEVWDHFFTETLPTLQAIFYPVQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 821079 - protein, 139 aa, Homo sapiens
MPVFSRAPARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 821080 - protein, 99 aa, Homo sapiens
SATGRTIQVAHFSPVRKLPREDRKLFPRRAESGAEASGGCARLGVIHAGDPKEKRQFGHKEKHQGHECTEERPCDGMATRQPSVNQGERPQRKSTLLTP

SEQ ID NO: 821081 - protein, 135 aa, Homo sapiens
MVGEPSGPRGEAELSPGLMTRGFAPILPVEFHKMGSFRRPRPRFMSSPVLSDLPRFQATRQALQLSSSSAWNRRLLKSELGSFITDYFQKRQFGHKEKHQGHECTEERPCDGMATRQPSVNQGERPQRKSTLLTP

SEQ ID NO: 821082 - protein, 368 aa, Homo sapiens
MTRGFAPILPVEFHKMGSFRRPRPRFMSSPVLSDLPRFQATRQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 821083 - protein, 368 aa, Homo sapiens; identical to SEQ ID NO: 821082

SEQ ID NO: 821084 - protein, 344 aa, Homo sapiens
MEGGRAGLSDLPRFQATRQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 821085 - protein, 193 aa, Homo sapiens
DPGPQCKDAEDGRYAGVAFSLGGFQIEELSSCLDSGAVGDELPVVSDMPVSAMALLPKGLAHLPMWIQVPTGGLVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 821086 - protein, 257 aa, Homo sapiens [sequence omitted]

SEQ ID NO: 821087 - protein, 460 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREQEKRLQQLAEPQSDLEELKHENKSALQLEQQVKELQEKLGQVTETLTSAEKEPEAAVPASGTGGESSGLMDLLEEKVDLREHVEKLELGFIQYRRERCHQKVHRLLTEPGDSAKDASPGGGHHQAGPGRGGEEGEAVGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 821088 - protein, 460 aa, Homo sapiens; identical to SEQ ID NO: 821087

SEQ ID NO: 821089 - protein, 558 aa, Homo sapiens
MCSLISYSQQQSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREQEKRLQQLAEPQSDLEELKHENKSALQLEQQVKELQEKLGQVTETLTSAEKEPEAAVPASGTGGESSGLMDLLEEKVDLREHVEKLELGFIQYRRERCHQKVHRLLTEPGDSAKDASPGGGHHQAGPGRGGEEGEAVGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 821090 - protein, 600 aa, Homo sapiens
QKGEPFSNSISRGLCYCPLKRFLIQTLSCEAVAENQQRPKSSVLGSLGTVPVPIGSENFAFKIHSWPLPAASCLGNRVEGATLHHFNLTLPKKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREQEKRLQQLAEPQSDLEELKHENKSALQLEQQVKELQEKLGQVTETLTSAEKEPEAAVPASGTGGESSGLMDLLEEKVDLREHVEKLELGFIQYRRERCHQKVHRLLTEPGDSAKDASPGGGHHQAGPGRGGEEGEAVGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 821091 - protein, 206 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGPSGWFGELLVRGEGELTEA

SEQ ID NO: 821092 - protein, 84 aa, Homo sapiens
QLEQQVKELQEKLGQVTETLTSAEKEPEAAVPASGTGGESVSGETLRPCRKSWRSWRGVSPSMGQEGQGWGRSLLRCDPIILAP

SEQ ID NO: 821093 - protein, 460 aa, Homo sapiens; identical to SEQ ID NO: 821087

SEQ ID NO: 821094 - protein, 460 aa, Homo sapiens; identical to SEQ ID NO: 821087

SEQ ID NO: 821095 - protein, 183 aa, Homo sapiens
MDLLEEKVDLREHVEKLELGFIQYRRERCHQKVHRLLTEPGDSAKDASPGGGHHQAGPGRGGEEGEAVGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 821096 - protein, 348 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREQEKRLQQLAEPQSDLEELKHENKSALQLEQQVKELQEKLGQVTETLTSAEKEPEAAVPASGTGGESSGLMDLLEEKVDLREHVEKLELGFIQYRRERCHQKVHRLLTEPGDSAKDASPGGGHHQAGPGRGGEEGRVCNIP

SEQ ID NO: 821097 - protein, 182 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCIIEEVLKKNCPHIVVGTPGRILAVARNKSLNLKHIKHFILDECDKMLEQLDMRRDVQNFSMTPHEKLAE

SEQ ID NO: 821098 - protein, 195 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVRIFRKKKRICHSFSSLFNLSTSKSWLHGSIFGDINSSPSEDNWLKGTRRLDTDHCNGNETRLLQEVFFQAILLAVCLIISACARWIHGETF

SEQ ID NO: 821099 - protein, 69 aa, Homo sapiens
FCFFASGYAGCFQKKTREVVRLTFPRTIHSFIPGNRQENKRLPKTKLLCKHLCTAMCVGICEKKRICEV

SEQ ID NO: 821100 - protein, 332 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVRIFRKKKRICHSFSSLFNLSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLIISACARWFMGEILASVFTCSLMITVAYVKSLFLSLASYFKTTACARLSKFDNHLGMPSMNVLHLNIWKLSNLQSTWNQVFYWKGVSE

SEQ ID NO: 821101 - protein, 276 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLIISACARWFMGEILASVFTCSLMITVAYVKSLFLSLASYFKTTACARFVKI

SEQ ID NO: 821102 - protein, 598 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821103 - protein, 535 aa, Homo sapiens
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821104 - protein, 153 aa, Homo sapiens
LSLFGINCRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821105 - protein, 598 aa, Homo sapiens; identical to SEQ ID NO: 821102

SEQ ID NO: 821106 - protein, 598 aa, Homo sapiens; identical to SEQ ID NO: 821102

SEQ ID NO: 821107 - protein, 401 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821108 - protein, 535 aa, Homo sapiens; identical to SEQ ID NO: 821103

SEQ ID NO: 821109 - protein, 598 aa, Homo sapiens; identical to SEQ ID NO: 821102

SEQ ID NO: 821110 - protein, 555 aa, Homo sapiens
MDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821111 - protein, 662 aa, Homo sapiens
MSSYHTDRWPRTNIRTEDIVMELTSPSLLLNILAVFVLHRIADTVLTFNLRHLKTQLVTYALKAMPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821112 - protein, 455 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRI

SEQ ID NO: 821113 - protein, 216 aa, Homo sapiens
MKFQFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 821114 - protein, 598 aa, Homo sapiens; identical to SEQ ID NO: 821102

SEQ ID NO: 821115 - protein, 598 aa, Homo sapiens; identical to SEQ ID NO: 821102

SEQ ID NO: 821116 - protein, 598 aa, Homo sapiens; identical to SEQ ID NO: 821102

SEQ ID NO: 821117 - protein, 454 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYR

SEQ ID NO: 821118 - protein, 33 aa, Homo sapiens
MNIDISAFSCIAALAMVTGQYCRRRALPLQNCL

SEQ ID NO: 821119 - protein, 178 aa, Homo sapiens
LLLLNSRPARQHYKKYLMGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821120 - protein, 104 aa, Homo sapiens
GRWTKTPDLPHAEIYTSVPKEHLLVSIPLLINHLQAESIVVHTYAAHALERLFTMRGPNNATLFTAAEIAPFVEILLTNLFKALTLPGSSENEYIMKEPKQTSL

SEQ ID NO: 821121 - protein, 93 aa, Homo sapiens
MELSDANLQTLTEYLKKTLDPDPAIRRPAEKFLESVEGNQNYPLLLLTLLEKSQDNVIKVCASVTFKNYIKRNWRIEDEPNLSSPELQKQLSV

SEQ ID NO: 821122 - protein, 971 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821123 - protein, 971 aa, Homo sapiens; identical to SEQ ID NO: 821122

SEQ ID NO: 821124 - protein, 971 aa, Homo sapiens; identical to SEQ ID NO: 821122

SEQ ID NO: 821125 - protein, 971 aa, Homo sapiens; identical to SEQ ID NO: 821122

SEQ ID NO: 821126 - protein, 971 aa, Homo sapiens; identical to SEQ ID NO: 821122

SEQ ID NO: 821127 - protein, 1026 aa, Homo sapiens
LVDGRESAVEMKVRFTADEYDSEMDFGVGLVSGCSLRIGGPFNASVSVSPRDPIAMELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821128 - protein, 872 aa, Homo sapiens
MLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821129 - protein, 737 aa, Homo sapiens
METWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821130 - protein, 860 aa, Homo sapiens
LVDGRESAVEMKVRFTADEYDSEMDFGVGLVSGCSLRIGGPFNASVSVSPRDPIAMELSDANLQTLTEYLKKTLDPDPAIRRPAEKFLESVEGNQNYPLLLLTLLEKSQDNVIKDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821131 - protein, 945 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRTYF

SEQ ID NO: 821132 - protein, 945 aa, Homo sapiens; identical to SEQ ID NO: 821131

SEQ ID NO: 821133 - protein, 558 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLTQANLTLITTCLKQYVYP

SEQ ID NO: 821134 - protein, 945 aa, Homo sapiens; identical to SEQ ID NO: 821131

SEQ ID NO: 821135 - protein, 962 aa, Homo sapiens [sequence omitted]

SEQ ID NO: 821136 - protein, 809 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKKCLEWFWKKLLFLKFRRYLEM

SEQ ID NO: 821137 - protein, 305 aa, Homo sapiens
MSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821138 - protein, 790 aa, Homo sapiens [sequence omitted]

SEQ ID NO: 821139 - protein, 265 aa, Homo sapiens
RSRGPHAHAGKHNSKCAVDKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821140 - protein, 261 aa, Homo sapiens
PASEQFLTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 821141 - protein, 178 aa, Homo sapiens; identical to SEQ ID NO: 821119

SEQ ID NO: 821142 - protein, 195 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKVWNASW

SEQ ID NO: 821143 - protein, 195 aa, Homo sapiens; identical to SEQ ID NO: 821142

SEQ ID NO: 821144 - protein, 83 aa, Homo sapiens
PVVLEDPNNGVTVWYLSVTIGHILLVIGYANRRVTSQVVYRLSQEGPIFEGIKAVPSMVSTSLNAEALQYLQGYLQAASVTLL

SEQ ID NO: 821145 - protein, 105 aa, Homo sapiens
MELSDANLQTLTEYLKKTLDPDPAIRRPAEKFLESVEGNQNYPLLLLTLLEKSQDNVIKVCASVTFKNYIKRNWRIVPSMVSTSLNAEALQYLQGYLQAASVTLL

SEQ ID NO: 821146 - protein, 528 aa, Homo sapiens
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 821147 - protein, 601 aa, Homo sapiens
MLTRKPSAAAPAAYPTGRGGDSAVRQLQASPGLGAGATRSGVGTGPPSPIALPPLRASNAAAAAHTIGGSKHTMNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 821148 - protein, 601 aa, Homo sapiens; identical to SEQ ID NO: 821147

SEQ ID NO: 821149 - protein, 601 aa, Homo sapiens; identical to SEQ ID NO: 821147

SEQ ID NO: 821150 - protein, 601 aa, Homo sapiens; identical to SEQ ID NO: 821147

SEQ ID NO: 821151 - protein, 210 aa, Homo sapiens
GRARAGPGEAPEPGGLRSSQRFQLPAPLCEGDGEARGAQGRARHVHGPEGAAAARGRGGRRRGGERGARGGGPRPRGCSGLCVSGCSRREAATRRRGPARGAAGRRRRRPPEVAAGPAAATAALKCIFLSSGHVNQETFGRRSRRLPDRPRWGQRRSSASGFPGARCRGHPERSGDWPALPHRPAASPGQQRCRRSPHGPHRLSECLRRS

SEQ ID NO: 821152 - protein, 181 aa, Homo sapiens
IHPRHPEAAVPTNRSYCWRPEEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 821153 - protein, 169 aa, Homo sapiens
MVFPLPTPQEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 821154 - protein, 171 aa, Homo sapiens
NLRLGSEAGCEEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 821155 - protein, 171 aa, Homo sapiens; identical to SEQ ID NO: 821154

SEQ ID NO: 821156 - protein, 171 aa, Homo sapiens
IHPRHPEAAVPTNRSYCWRPEEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTEGSSTRPTQGLLISSHITFARGWTSASIS

SEQ ID NO: 821157 - protein, 169 aa, Homo sapiens; identical to SEQ ID NO: 821153

SEQ ID NO: 821158 - protein, 169 aa, Homo sapiens; identical to SEQ ID NO: 821153

SEQ ID NO: 821159 - protein, 169 aa, Homo sapiens; identical to SEQ ID NO: 821153

SEQ ID NO: 821160 - protein, 169 aa, Homo sapiens; identical to SEQ ID NO: 821153

SEQ ID NO: 821161 - protein, 167 aa, Homo sapiens
MVFPLPTPQEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEVRAAHPHYQTLCLGW

SEQ ID NO: 821162 - protein, 162 aa, Homo sapiens
MVFPLPTPQEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTDVELIGFHKAQQQPHQGLHEYQSPYPHVARGA

SEQ ID NO: 821163 - protein, 102 aa, Homo sapiens
MVFPLPTPQEPIMATPPKRRAVEATGEKVLRYETFISDVLQRDLRKVLDHRDKVYEQLAKYLQLRNVIERLQEAKHSELYMQVDLGCNFFVDTVVGRSSQVH

SEQ ID NO: 821164 - protein, 130 aa, Homo sapiens
MNGAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 821165 - protein, 224 aa, Homo sapiens
MKSRIPVVLLACGSFNPITNMHLRMFEVARDHLHQTGMYQVIQGIISPVNDTYGKKDLAASHHRVAMARLALQTSDWIRVDPWESEQAQWMETVKVLAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 821166 - protein, 215 aa, Homo sapiens
MYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 821167 - protein, 266 aa, Homo sapiens
KSSFKRKRTEEQAFCDLNDSKCKGTTLKKIIFIDSTWNQTNKIFTDERLQGMYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 821168 - protein, 75 aa, Homo sapiens
IAKGRGADLFPSDSICPGPLRERKVKFALALPPAQVLGGLDLRLPGPEAALSPETKRRFPLGPRAPGRALTDSPC

SEQ ID NO: 821169 - protein, 75 aa, Homo sapiens; identical to SEQ ID NO: 821168

SEQ ID NO: 821170 - protein, 252 aa, Homo sapiens
MKSRIPVVLLACGSFNPITNMHLRMFEVARDHLHQTGMYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 821171 - protein, 252 aa, Homo sapiens; identical to SEQ ID NO: 821170

SEQ ID NO: 821172 - protein, 140 aa, Homo sapiens
MDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 821173 - protein, 245 aa, Homo sapiens
VHGGVLGARRPPRVWYPELRELSAAAPRWSHRTAPGIMVFYFTSSSVNSSAYTIYMGKDKYENEDLIKHGWPEDIWFHVDKLSSAHVYLRLHKGENIEDIPKEVLMDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 821174 - protein, 79 aa, Homo sapiens
VHGGVLGARRPPRVWYPELRELSAAAPRWSHRTAPGIMVFYFTSSSVNSSAYTIYMGKDKYENEDLIKHGWPEDIWERI

SEQ ID NO: 821175 - protein, 245 aa, Homo sapiens; identical to SEQ ID NO: 821173

SEQ ID NO: 821176 - protein, 140 aa, Homo sapiens; identical to SEQ ID NO: 821172

SEQ ID NO: 821177 - protein, 79 aa, Homo sapiens; identical to SEQ ID NO: 821174

SEQ ID NO: 821178 - protein, 239 aa, Homo sapiens
VHGGVLGARRPPRVWYPELRELSAAAPRWSHRTAPGIMVFYFTSSSVNSSAYTIYMGKDKYENEDLIKHGWPEDIWFHVDKLSSAHVYLRLHKGENIEDIPKEVLMDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRMAMIQMNSCKRRKGEKDL

SEQ ID NO: 821179 - protein, 129 aa, Homo sapiens
VHGGVLGARRPPRVWYPELRELSAAAPRWSHRTAPGIMVFYFTSSSVNSSAYTIYMGKDKYENEDLIKHGWPEDIWFHVDKLSSAHVYLRLHKGENIEDIPKEVLMDCAHLVKANSIQGKNCDSGEESK

SEQ ID NO: 821180 - protein, 140 aa, Homo sapiens; identical to SEQ ID NO: 821172

SEQ ID NO: 821181 - protein, 134 aa, Homo sapiens
MDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRMAMIQMNSCKRRKGEKDL

SEQ ID NO: 821182 - protein, 123 aa, Homo sapiens
VHGGVLGARRPPRVWYPELRELSAAAPRWSHRTAPGIMVFYFTSSSVNSSAYTIYMGKDKYENEDLIKHGWPEDIWFHVDKLSSAHVYLRLHKGENIEDIPKEVLMDCAHLVKANSIQGAIHH

SEQ ID NO: 821183 - protein, 245 aa, Homo sapiens; identical to SEQ ID NO: 821173

SEQ ID NO: 821184 - protein, 129 aa, Homo sapiens; identical to SEQ ID NO: 821179

SEQ ID NO: 821185 - protein, 630 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821186 - protein, 204 aa, Homo sapiens
MCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821187 - protein, 96 aa, Homo sapiens
FSLSPPPLLSPNTQHDLAIRLSLEQALPPEPKEENAEPVSKLRIRTPSGEFLERRFLASNKLQIVFDFVASKGFPWDEYKLLSTFPRRDVTQPGPK

SEQ ID NO: 821188 - protein, 201 aa, Homo sapiens
NSFLATTCHSDVTPLAKRKDALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMNDAEKQDNEGDAYKITAELLQRYERRHPVLKWLHRSGNKRPSK

SEQ ID NO: 821189 - protein, 630 aa, Homo sapiens; identical to SEQ ID NO: 821185

SEQ ID NO: 821190 - protein, 643 aa, Homo sapiens
GPLPLPLPTSWVSGATRESSSQRLNAAVACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821191 - protein, 543 aa, Homo sapiens
MPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821192 - protein, 613 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821193 - protein, 476 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGLTFSYRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821194 - protein, 630 aa, Homo sapiens; identical to SEQ ID NO: 821185

SEQ ID NO: 821195 - protein, 630 aa, Homo sapiens; identical to SEQ ID NO: 821185

SEQ ID NO: 821196 - protein, 630 aa, Homo sapiens; identical to SEQ ID NO: 821185

SEQ ID NO: 821197 - protein, 630 aa, Homo sapiens; identical to SEQ ID NO: 821185

SEQ ID NO: 821198 - protein, 454 aa, Homo sapiens
MCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENLQMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821199 - protein, 415 aa, Homo sapiens
MFLGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENLQMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQPGPK

SEQ ID NO: 821200 - protein, 641 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEERETIRMYFKSSAMNYLQPQERTMLKPREDKTMRESENHQEDEVHRKQGVIHGTKNEPPRNGHKNNETHIAKQETPLRMKTKTTGATYPKEEK

SEQ ID NO: 821201 - protein, 667 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGTGERRDDASMSFTLVITRVVCDNGPVSLDQAQATARERITREEDAQSSTVYSLTAKCRMKKTQRMEGTCSALFNLEGMTRRQGEGACSTEDDEIGERLCFVFVIPEFRQRRPQTDGRVTAIRLSLEQALPPEPKEENAEPVSKLRIRTPSGEFLERRFLASNKLQIVFDFVASKGFPWDEYKLLSTFPRRDVTQPGPK

SEQ ID NO: 821202 - protein, 96 aa, Homo sapiens
GVSTCYVIYFVLYCDFLAIRLSLEQALPPEPKEENAEPVSKLRIRTPSGEFLERRFLASNKLQIVFDFVASKGFPWDEYKLLSTFPRRDVTQPGPK

SEQ ID NO: 821203 - protein, 204 aa, Homo sapiens; identical to SEQ ID NO: 821186

SEQ ID NO: 821204 - protein, 136 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGKVFPAIKPSQINN

SEQ ID NO: 821205 - protein, 254 aa, Homo sapiens
MNKLFSFWKRKNETRSQGYNLREKDLKKLHRAASVGDLKKLKEYLQIKKYDVNMQDKKYRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 821206 - protein, 254 aa, Homo sapiens; identical to SEQ ID NO: 821205

SEQ ID NO: 821207 - protein, 254 aa, Homo sapiens; identical to SEQ ID NO: 821205

SEQ ID NO: 821208 - protein, 196 aa, Homo sapiens
MITPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 821209 - protein, 274 aa, Homo sapiens
MNKLFSFWKRKNETRSQGYNLREKDLKKLHRAASVGDLKKLKEYLQIKKYDVNMQDKKYSVVQSSRWLLSYTTPLNDFIRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 821210 - protein, 216 aa, Homo sapiens
MIVVQSSRWLLSYTTPLNDFIRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 821211 - protein, 242 aa, Homo sapiens [sequence omitted]

SEQ ID NO: 821212 - protein, 237 aa, Homo sapiens
MNKLFSFWKRKNETRSQGYNLREKDLKKLHRAASVGDLKKLKEYLQIKKYDVNMQDKKYRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEDRYPQFTASHGKKKHAK

SEQ ID NO: 821213 - protein, 183 aa, Homo sapiens
GGGGGAGRSRGRAFWGRGLVRLTLEGFASASETVRILMTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 821214 - protein, 78 aa, Homo sapiens
GGGGGAGRSRGRAFWGRGLVRLTLEGFASASETVREGSEQAPLMSEDELINIIDGVLRDDDKNNDGYIDYAEFAKSLQ

SEQ ID NO: 821215 - protein, 224 aa, Homo sapiens
MEHLEGVINKPEAEMSPQELQLHYFKMHDYDGNNLLDGLELSTAITHVHKERTGSEQAPLHECTTEPDLTYLRLVYIDDELTDQRHQLDCDYHLTLLADTLPHTPLDHVRTVPQRALLPWVPYTHRLVNPLDSRGSSLSKRTYVRISTRPQTQLDQLAVYIPTTVTLDQWHQSDINMGRSKSTPVRLTPALVTSITSKRWMGALTRQRHETTKSQVKTLATRHD

SEQ ID NO: 821216 - protein, 183 aa, Homo sapiens; identical to SEQ ID NO: 821213

SEQ ID NO: 821217 - protein, 183 aa, Homo sapiens; identical to SEQ ID NO: 821213

SEQ ID NO: 821218 - protein, 165 aa, Homo sapiens
GGGGGAGRSRGRAFWGRGLVRLTLEGFASASETVRILMTMRSLLRTPFLCGLLWAFCAPGARAEEPAASFSQPGSMGLDKNTVHDQEHIMEHLEGVINKPEAEMSPQELQLHYFTITHVHKEEGSEQAPLMSEDELINIIDGVLRDDDKNNDGYIDYAEFAKSLQ

SEQ ID NO: 821219 - protein, 160 aa, Homo sapiens
GGGGGAGRSRGRAFWGRGLVRLTLEGFASASETVRILMTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEANLCTELTLRRTGTFPIKEE

SEQ ID NO: 821220 - protein, 118 aa, Homo sapiens
GGGGGAGRSRGRAFWGRGLVRLTLEGFASASETVRILMTMRSLLRTPFLCGLLWAFCAPGARAEEPAASFSQPGSMGLDKNTVHDQEHIMEHLEGVINKPEAEMSPQELQLHYFKMHD

SEQ ID NO: 821221 - protein, 96 aa, Homo sapiens
FCFPAVMTYAHENMPLAKDLLHPSPEEEKRKHKKKRLVQSPNSYFMDVKCPGCYKITTVFSHAQTVVLCVGCSTVLCQPTGKARLTEGCSFRRKQH

SEQ ID NO: 821222 - protein, 110 aa, Homo sapiens
CVGACSPPSFSCWAFSPLKLFTASSYLEHITSGPILAVSSSGFLTKGAPPGHLAPQTCRLLPLRFLISGPPLDHMSSGPPGAGTTAENSCRIRHEYRRMFLQEEAALKAL

SEQ ID NO: 821223 - protein, 96 aa, Homo sapiens; identical to SEQ ID NO: 821221

SEQ ID NO: 821224 - protein, 399 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821225 - protein, 399 aa, Homo sapiens; identical to SEQ ID NO: 821224

SEQ ID NO: 821226 - protein, 204 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEMIGSTKSVMSTEGFQLKRNMSGINMSTPLAAIVPVSREGTPCVIFVMPGKILVTDGHVSLSFFDAGSPAWI

SEQ ID NO: 821227 - protein, 168 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKGTCWTKHKVSYKGLVLTTHTHWQRQADQWGRRETQGHSGLGAGHWKGGSISMEMSCVEND

SEQ ID NO: 821228 - protein, 106 aa, Homo sapiens
ISSPVCYCVDPFFFLTFSSYLQSGRSDQNMLWYSTVLTCITAGLSAHESEKQKATWVTLCKGLWCSKLSRQRSENLEFCLNCAFIPDWFIITLGTKRLAVAGVLVE

SEQ ID NO: 821229 - protein, 399 aa, Homo sapiens; identical to SEQ ID NO: 821224

SEQ ID NO: 821230 - protein, 399 aa, Homo sapiens; identical to SEQ ID NO: 821224

SEQ ID NO: 821231 - protein, 399 aa, Homo sapiens; identical to SEQ ID NO: 821224

SEQ ID NO: 821232 - protein, 369 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMAAVL

SEQ ID NO: 821233 - protein, 361 aa, Homo sapiens
MMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821234 - protein, 361 aa, Homo sapiens; identical to SEQ ID NO: 821233

SEQ ID NO: 821235 - protein, 404 aa, Homo sapiens
RYPSTLYTSRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821236 - protein, 361 aa, Homo sapiens; identical to SEQ ID NO: 821233

SEQ ID NO: 821237 - protein, 436 aa, Homo sapiens
VFVVSSFLPTNQSSQIRQNYSTDVEAAVNSLVNLYLQAVLLPVFFSLLLEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821238 - protein, 361 aa, Homo sapiens; identical to SEQ ID NO: 821233

SEQ ID NO: 821239 - protein, 423 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRYLIFLLFSLYLYGECNAITCFSQRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821240 - protein, 191 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEEIHTDLYV

SEQ ID NO: 821241 - protein, 201 aa, Homo sapiens
MGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821242 - protein, 313 aa, Homo sapiens
ISSPVCYCVDPFFFLTFSSYLQSGRSDQNMLWYSTVLTCITAGLSAHESEKQKATWVTLCKGLWCSKLSRQRSENLEFCLNCAFIPDWFIIYIRDKKVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821243 - protein, 231 aa, Homo sapiens
MTCFSKSQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 821244 - protein, 180 aa, Homo sapiens [sequence omitted]

SEQ ID NO: 821245 - protein, 180 aa, Homo sapiens [sequence omitted]

SEQ ID NO: 821246 - protein, 399 aa, Homo sapiens; identical to SEQ ID NO: 821224

SEQ ID NO: 821247 - protein, 399 aa, Homo sapiens; identical to SEQ ID NO: 821224

SEQ ID NO: 821248 - protein, 399 aa, Homo sapiens; identical to SEQ ID NO: 821224

SEQ ID NO: 821249 - protein, 399 aa, Homo sapiens; identical to SEQ ID NO: 821224

SEQ ID NO: 821250 - protein, 567 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMAAVLWALGFIFLFTVGGLTGIVLANSSLDIVLHDTYYVVAHFHYVLSIGAVFAIIGGFIHCFPLFSGYTLDQTYAKIHFIYHIHRRKSELSSHNTFLRLIRKLRRYSDYPDAYTIMKHPIICRLIHFSNSSNINNFHDLRLRFAKILISKRTLHKPGIDYDAPPPYHTFRRTRYTKIKKERNPNPPQAWFSKPNPPWAPMNF

SEQ ID NO: 821251 - protein, 303 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGGPVNPDRLCLPSSPV

SEQ ID NO: 821252 - protein, 271 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVGSGEPSKEEKAVAKYLRFNCPTKSTNMD

SEQ ID NO: 821253 - protein, 205 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILGK

SEQ ID NO: 821254 - protein, 205 aa, Homo sapiens; identical to SEQ ID NO: 821253

SEQ ID NO: 821255 - protein, 188 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVRVSL

SEQ ID NO: 821256 - protein, 154 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDESRRAGTSFYFFSCDAERTHLL

SEQ ID NO: 821257 - protein, 163 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 821258 - protein, 163 aa, Homo sapiens; identical to SEQ ID NO: 821257

SEQ ID NO: 821259 - protein, 163 aa, Homo sapiens; identical to SEQ ID NO: 821257

SEQ ID NO: 821260 - protein, 191 aa, Homo sapiens
MHGVVAKSRAFGCEVPEYSSCLPLCVPGDRVNTQEALPTAAIPRDAKGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 821261 - protein, 184 aa, Homo sapiens
MDLLNEGAPCKPGPHPGFWLWAQGCPGSTTLAEFLPASPPGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 821262 - protein, 191 aa, Homo sapiens; identical to SEQ ID NO: 821260

SEQ ID NO: 821263 - protein, 184 aa, Homo sapiens; identical to SEQ ID NO: 821261

SEQ ID NO: 821264 - protein, 145 aa, Homo sapiens
MADEEKLPPGWEKRMSRSSGRVYYFNHITNASQWERPSGNSSSGGNSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 821265 - protein, 142 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGAQGMGLTRSDAEAI

SEQ ID NO: 821266 - protein, 170 aa, Homo sapiens
MHGVVAKSRAFGCEVPEYSSCLPLCVPGDRVNTQEALPTAAIPRDAKGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGAQGMGLTRSDAEAI

SEQ ID NO: 821267 - protein, 163 aa, Homo sapiens; identical to SEQ ID NO: 821257

SEQ ID NO: 821268 - protein, 163 aa, Homo sapiens; identical to SEQ ID NO: 821257

SEQ ID NO: 821269 - protein, 163 aa, Homo sapiens; identical to SEQ ID NO: 821257

SEQ ID NO: 821270 - protein, 133 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFRSAEPPRVPPGAGGRLEGRIVSS

SEQ ID NO: 821271 - protein, 145 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGAQGMGLTRLGDPYHPEG

SEQ ID NO: 821272 - protein, 138 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKVSRAAPCPPRCWRQTRGPNCF

SEQ ID NO: 821273 - protein, 181 aa, Homo sapiens
MADEEKLPPGWEKRMSRSSGVNTQEALPTAAIPRDAKGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 821274 - protein, 149 aa, Homo sapiens
GGHGKTCVQLSGQHSLLEQPQWDSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821275 - protein, 145 aa, Homo sapiens
MKQLPVLEPGDKPRKATWYTLTVPGDSPCARVGHSCSYLPPVGNAKRGKVFIVGGANPNRSFSDVHTMDLETRTWTTPEVTSPPPSPRTFHTSSAAIGNQLYVFGGGERGAQPVQDTKLHVFDASMDWWAPWGWSGPSQFTHYLI

SEQ ID NO: 821276 - protein, 372 aa, Homo sapiens
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821277 - protein, 372 aa, Homo sapiens; identical to SEQ ID NO: 821276

SEQ ID NO: 821278 - protein, 372 aa, Homo sapiens; identical to SEQ ID NO: 821276

SEQ ID NO: 821279 - protein, 372 aa, Homo sapiens; identical to SEQ ID NO: 821276

SEQ ID NO: 821280 - protein, 292 aa, Homo sapiens
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTETGFHRVSQDGLHLLTS

SEQ ID NO: 821281 - protein, 465 aa, Homo sapiens
RGELRLGTRLGRGSPDTGSITVSGRESESFRGVGPSRVQRTGKGLPWLRPGHFDRISLFFPDPVSYPLELPRGDEICWAGSGGCCGRSRPREASLTELWTLGTAVSGLGRRYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821282 - protein, 305 aa, Homo sapiens
MDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821283 - protein, 354 aa, Homo sapiens
MKQLPVLEPGDKPRKATWYTLTVPGDSPCARVGHSCSYLPPVGNAKRGKVFIVGGANPNRSFSDVHTMDLDASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821284 - protein, 321 aa, Homo sapiens
MKQLPVLEPGDKPRKATWYTLTVPGDSPCARVGHSCSYLPPVGNAKRGKVFIVGGANPNRSFSDVHTMDLETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821285 - protein, 318 aa, Homo sapiens
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPDTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821286 - protein, 175 aa, Homo sapiens
MVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821287 - protein, 267 aa, Homo sapiens
MKQLPVLEPGDKPRKATWYTLTVPGDSPCARVGHSCSYLPPVGNAKRGKVFIVGGANPNRSFSDVHTMDLDTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821288 - protein, 175 aa, Homo sapiens; identical to SEQ ID NO: 821286

SEQ ID NO: 821289 - protein, 146 aa, Homo sapiens
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTIPTLSL

SEQ ID NO: 821290 - protein, 112 aa, Homo sapiens
MTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821291 - protein, 112 aa, Homo sapiens; identical to SEQ ID NO: 821290

SEQ ID NO: 821292 - protein, 157 aa, Homo sapiens
MKQLPVLEPGDKPRKATWYTLTVPGDSPCARVGHSCSYLPPVGNAKRGKVFIVGGANPNRKEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 821293 - protein, 113 aa, Homo sapiens
RGELRLGTRLGRGSPDTGSITVSGRESESFRGVGPSRVQRTGKGLPWLRPGHFDRISLFFPDPVSYPLELPRGDEICWAGSGGCCGRSRPREASLTELWTLGTAVSGLGRRTP

SEQ ID NO: 821294 - protein, 113 aa, Homo sapiens; identical to SEQ ID NO: 821293

SEQ ID NO: 821295 - protein, 113 aa, Homo sapiens; identical to SEQ ID NO: 821293

SEQ ID NO: 821296 - protein, 71 aa, Homo sapiens
NQYNNWQPQSRNWVKCFPGKHQWDLDTCKGLLPRYEHASFIPSCTPDRIWVFGGANQSGNRNCLQVLNPGK

SEQ ID NO: 821297 - protein, 581 aa, Homo sapiens
ALLNDPRRRVLNPRLTSVSPGARASPRARASASPKAPPQGAALPTCSPTCSLEGGARGRADKMFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 821298 - protein, 630 aa, Homo sapiens
MRAHTNAGAHECRAHTNAGAHECGRTRMRAHTNAGAPLSPLHNRGLIPAVQSAGAAHPSRPLDSRPSRPAPEPVRAHARLRPRKPRPQGAALPTCSPTCSLEGGARGRADKMFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 821299 - protein, 612 aa, Homo sapiens
MRAHTNAGAHECRAHTNAGAHECGRTRMRAHTNAGAPLSPLHNRGLIPAVQSAGAAHPSRPLDSRPSRPAPEPVRAHARLRPRKPRPQGAALPTCSPTCSLEGGARGRADKMFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAMADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 821300 - protein, 630 aa, Homo sapiens; identical to SEQ ID NO: 821298

SEQ ID NO: 821301 - protein, 420 aa, Homo sapiens
VDPCGDAQAAAEGAVLGLYEYIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 821302 - protein, 349 aa, Homo sapiens [sequence omitted]

SEQ ID NO: 821303 - protein, 545 aa, Homo sapiens
MRAHTNAGAHECRAHTNAGAHECGRTRMRAHTNAGAPLSPLHNRGLIPAVQSAGAAHPSRPLDSRPSRPAPEPVRAHARLRPRKPRPQGAALPTCSPTCSLEGGARGRADKMFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEVGIIFVYLNCRDGE

SEQ ID NO: 821304 - protein, 131 aa, Homo sapiens
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAGYFTF

SEQ ID NO: 821305 - protein, 672 aa, Homo sapiens
YRCDRACNPGTDAWAAIDAAFSRGGLGKEEGRRGQRGRLQQEARRGRRGRGETEYSQRLPASVALGQTREAPGRCHHRWRSKWRWERSYITRLLCIDYVPGTMLPINTLHHLILSASPGKYDATRFHRQGNKPREGDECTQGQQLVMLMLLVRGTHYENLRSKVVLPTPLGGRSTETFVSEFPGPDTGIRWRRSDEALRVNVGGVRRQLSARALARFPGTRLGRLQAAASEEQARRLCDDYDEAAREFYFDRHPGFFLSLLHFYRTGHLHVLDELCVFAFGQEADYWGLGENALAACCRARYLERRLTQPHAWDEDSDTPSSVDPCPDEISDVQRELARYGAARCGRLRRRLWLTMENPGYSLPSKLFSCVSISVVLASIAAMCIHSLPEYQAREAAAAVAAVAAGRSPEGVRDDPVLRRLEYFCIAWFSFEVSSRLLLAPSTRNFFCHPLNLIDIVSVLPFYLTLLAGVALGDQGGKEFGHLGKVVQVFRLMRIFRVLKLARHSTGLRSLGATLKHSYREVGILLLYLAVGVSVFSGVAYTAEKEEDVGFNTIPACWWWGTVSMTTVGYGDVVPVTVAGKLAASGCILGGILVVALPITIIFNKFSHFYRRQKALEAAVRNSNHQEFEDLLSSIDGVSEASLETSRETSQEGQSADLESQAPSEPPHPQMY

SEQ ID NO: 821306 - protein, 137 aa, Homo sapiens
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 821307 - protein, 82 aa, Homo sapiens
LRLRQKDPRRDPYLRARYFIGRLTMAVVSTNEVTSTENHVCVQGRRGGGRGRAKLAGPVTFYQKVKPRQKSVSCSLPLHIFT

SEQ ID NO: 821308 - protein, 137 aa, Homo sapiens; identical to SEQ ID NO: 821306

SEQ ID NO: 821309 - protein, 137 aa, Homo sapiens; identical to SEQ ID NO: 821306

SEQ ID NO: 821310 - protein, 137 aa, Homo sapiens; identical to SEQ ID NO: 821306

SEQ ID NO: 821311 - protein, 137 aa, Homo sapiens; identical to SEQ ID NO: 821306

SEQ ID NO: 821312 - protein, 76 aa, Homo sapiens
AHGVRVPGGPAERSIGEQRRSVTHGFPGGAEQPGAACDLHTHGAPRKDTLKMLALPLCAHFCTVLEHDASYTHLCA

SEQ ID NO: 821313 - protein, 151 aa, Homo sapiens
MEGQAQGGDALKYSRAGPFLLKRSLQERSVWGGRGLCEAGPGARAGRGPRARGRGSRGQEEGEETGLGERPAERPPGSSRSRTASLYPPAARTKEGAQPAALASPPRVQLAQLAQRPPRLGQGFNGPHQNAISNGTRHGNHDVYISQIRWG

SEQ ID NO: 821314 - protein, 124 aa, Homo sapiens
SESHLVWLPVCRRGFSTELPASTDHTKMPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 821315 - protein, 75 aa, Homo sapiens
MPSQMEHAMETMMFTFHKFAGDKGYLTKEDLRVLMEKEFPGFLENQKRPGLWTKINEGTYQLLKMAKSAFEDFFF

SEQ ID NO: 821316 - protein, 148 aa, Homo sapiens
RQTTAGTHTARSSWWNRTRSPPRSPLRPASSSPSSPSVRRASAKASTDHTKMPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 821317 - protein, 121 aa, Homo sapiens
LLVIPDTGTLPAERASAASTDHTKMPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 821318 - protein, 151 aa, Homo sapiens; identical to SEQ ID NO: 821313

SEQ ID NO: 821319 - protein, 151 aa, Homo sapiens; identical to SEQ ID NO: 821313

SEQ ID NO: 821320 - protein, 38 aa, Homo sapiens
MAGVRKQHVLNMGDWAKGKSLDPSSMAQRGKTLQGHHK

SEQ ID NO: 821321 - protein, 151 aa, Homo sapiens; identical to SEQ ID NO: 821313

SEQ ID NO: 821322 - protein, 117 aa, Homo sapiens
MPSQMEHAMETMMFTFHKFAGDKGYLTKEDLRVLMEKEFPGFLEAIFLSLVDGMDPTGKTTPYRFLTSITTKRSAEANHHVSKIKAKGVLPAHLCSIHSYQALRVMGSLRLHPTYSF

SEQ ID NO: 821323 - protein, 133 aa, Homo sapiens
MPSQMEHAMETMMFTFHKFAGDKGYLTKEDLRVLMEKEFPGFLEAIFLSLVDGMDPTGKTTPYRFLTSITTKRSAEANHHNQKDPLAVDKIMKDLDQCRDGKVGFQSFFSLIAGLTIACNDYFVVHMKQKGKK

SEQ ID NO: 821324 - protein, 82 aa, Homo sapiens
ARYPSGEDCGSGEDCGSAKTVDQAKTVVENQKDPLAVDKIMKDLDQCRDGKVGFQSFFSLIAGLTIACNDYFVVHMKQKGKK

SEQ ID NO: 821325 - protein, 151 aa, Homo sapiens; identical to SEQ ID NO: 821313

SEQ ID NO: 821326 - protein, 117 aa, Homo sapiens; identical to SEQ ID NO: 821322

SEQ ID NO: 821327 - protein, 131 aa, Homo sapiens
MSGGHSSPEPPRPWPLDRGSLPSPPAFPPGIATRATRAWAAPAKMLPCARSACRARDSGLASGTRAEVGGGPASEEYARRLAGCCPRLARPSLPTCEMHRTGLHLFNESFLSSCCEPGLEQAWVLWMGAGP

SEQ ID NO: 821328 - protein, 322 aa, Homo sapiens
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIMNTLEKKAFLKRFPWMSAPIQVGLVGFCLVFATPLCCALFPQKSSMSVTSLEAELQAKIQESHPELRRVYFNKGL

SEQ ID NO: 821329 - protein, 322 aa, Homo sapiens; identical to SEQ ID NO: 821328

SEQ ID NO: 821330 - protein, 322 aa, Homo sapiens; identical to SEQ ID NO: 821328

SEQ ID NO: 821331 - protein, 261 aa, Homo sapiens
MITENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIMNTLEKKAFLKRFPWMSAPIQVGLVGFCLVFATPLCCALFPQKSSMSVTSLEAELQAKIQESHPELRRVYFNKGL

SEQ ID NO: 821332 - protein, 322 aa, Homo sapiens; identical to SEQ ID NO: 821328

SEQ ID NO: 821333 - protein, 322 aa, Homo sapiens; identical to SEQ ID NO: 821328

SEQ ID NO: 821334 - protein, 322 aa, Homo sapiens; identical to SEQ ID NO: 821328

SEQ ID NO: 821335 - protein, 242 aa, Homo sapiens
MITENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIMNTLEKKAFLKRFPWMSAPIQVGLVGFCLVFATPLCCALFPQKRYVFVIRQNHHEY

SEQ ID NO: 821336 - protein, 242 aa, Homo sapiens
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMG

SEQ ID NO: 821337 - protein, 145 aa, Homo sapiens
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVK

SEQ ID NO: 821338 - protein, 360 aa, Homo sapiens
APGLQVSQAPPPRRGFAVGRRYSPPALAPGRCAAPHGGGRKELPTRRPGHGMAPKFPDSVEELRAAGNESFRNGQYAEASALYGRALRVLQAQGSSDPEEESVLYSNRAACHLKDGNCRDCIKDCTSALALVPFSIKPLLRRASAYEALEKYPMAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 821339 - protein, 360 aa, Homo sapiens; identical to SEQ ID NO: 821338

SEQ ID NO: 821340 - protein, 360 aa, Homo sapiens; identical to SEQ ID NO: 821338

SEQ ID NO: 821341 - protein, 336 aa, Homo sapiens
EAEKTPILSKPGCNRTRHLPTRRPGHGMAPKFPDSVEELRAAGNESFRNGQYAEASALYGRALRVLQAQGSSDPEEESVLYSNRAACHLKDGNCRDCIKDCTSALALVPFSIKPLLRRASAYEALEKYPMAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 821342 - protein, 253 aa, Homo sapiens
GVLEDPRRMETQRRIKDCTSALALVPFSIKPLLRRASAYEALEKYPMAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 821343 - protein, 182 aa, Homo sapiens [sequence omitted]

SEQ ID NO: 821344 - protein, 241 aa, Homo sapiens
APGLQVSQAPPPRRGFAVGRRYSPPALAPGRCAAPHGGGRKELPTRRPGHGMAPKFPDSVEELRAAGNESFRNGQYAEASALYGRALRVLQAQGSSDPEEESVLYSNRAACHLKDGNCRDCIKDCTSALALVPFSIKPLLRRASAYEALEKYPMAYVDYKTVLQIDDNVTSAVEGINRMTRALMDSLGPEWRLKLPSIPLVPVSAQKRWNSLPSENHKEMAKSKSKETTATKNREHSAIWS

SEQ ID NO: 821345 - protein, 360 aa, Homo sapiens; identical to SEQ ID NO: 821338

SEQ ID NO: 821346 - protein, 360 aa, Homo sapiens; identical to SEQ ID NO: 821338

SEQ ID NO: 821347 - protein, 207 aa, Homo sapiens
MAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 821348 - protein, 221 aa, Homo sapiens
MRRASAYEALEKYPMAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 821349 - protein, 69 aa, Homo sapiens
SHLRACSSNSRNHRPGLARRPAVLPGPPTLPAPSDSGILPETSSALSFHLLVNCPVGPHPKLFRPRSEP

SEQ ID NO: 821350 - protein, 513 aa, Homo sapiens
SQPLGAACRVPATARVSGGRTRPEPVSARQPPAAAESPAASPPRAPSSTSRPALRSAADMCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 821351 - protein, 513 aa, Homo sapiens; identical to SEQ ID NO: 821350

SEQ ID NO: 821352 - protein, 380 aa, Homo sapiens
MPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 821353 - protein, 552 aa, Homo sapiens
SQPLGAACRVPATARVSGGRTRPEPVSARQPPAAAESPAASPPRAPSSTSRPALRSAADMCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERLSLCHPGWSAMARSRSLKPPPPVFKRFSCLSLPSSWDYRFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 821354 - protein, 513 aa, Homo sapiens; identical to SEQ ID NO: 821350

SEQ ID NO: 821355 - protein, 589 aa, Homo sapiens
MARCNSEKAHTKATTHHLSKKRPSEVINRIIPYRRPFWTGGVWWPWYVLSRVTSRHHWYMVSVLVSRPPAGRARVSGGRTRPEPVSARQPPAAAESPAASPPRAPSSTSRPALRSAADMCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 821356 - protein, 513 aa, Homo sapiens; identical to SEQ ID NO: 821350

SEQ ID NO: 821357 - protein, 513 aa, Homo sapiens; identical to SEQ ID NO: 821350

SEQ ID NO: 821358 - protein, 513 aa, Homo sapiens; identical to SEQ ID NO: 821350

SEQ ID NO: 821359 - protein, 494 aa, Homo sapiens
SQPLGAACRVPATARVSGGRTRPEPVSARQPPAAAESPAASPPRAPSSTSRPALRSAADMCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 821360 - protein, 121 aa, Homo sapiens
MLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPIQHESTFAEDPMFQSQTGQL

SEQ ID NO: 821361 - protein, 1477 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 821362 - protein, 442 aa, Homo sapiens
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 821363 - protein, 1484 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 821364 - protein, 1484 aa, Homo sapiens; identical to SEQ ID NO: 821363

SEQ ID NO: 821365 - protein, 144 aa, Homo sapiens
TYGEQAKTQIRKQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 821366 - protein, 182 aa, Homo sapiens
SGSQGALLSPVLISEDGLNFLGFPLRIKKKALSTQGSQTDMDMRWHCENSQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 821367 - protein, 145 aa, Homo sapiens
MIVSFLRPPEPCGTTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 821368 - protein, 1140 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDRKYLSEYGLILI

SEQ ID NO: 821369 - protein, 284 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGLAHLMMGDQGMGSVPFPLCFQCFLVL

SEQ ID NO: 821370 - protein, 326 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKEKLEIFRWIRKDFTNF

SEQ ID NO: 821371 - protein, 456 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPIQHESTFAEDPMFQSQTGQL

SEQ ID NO: 821372 - protein, 265 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKEKLEIFRWIRKDFTNF

SEQ ID NO: 821373 - protein, 443 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEIKEKKGNHSTY

SEQ ID NO: 821374 - protein, 1602 aa, Homo sapiens
ASGAAARPERRGGEDETGTRPGQEGAGQPREPRTPGKMLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAEALRREALGLEQLRARLEDALLRMREEYGIQAEERQRAIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSLKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEVSAGGDLSQAASPTGASRSVRHVTLGPGQSPLSREVIFLGPAPACPEAWGSPEPGPAESSADMDGSGRHSTFGCRQFHAEKEIIFQGPISAAGKVGDYFATEESVGTQTSVRQLQLGPKEGFSGQIQFTAPLSDKVELGVIGDSVHMEGLPGSSTSIRHISIGPQRHQTTQQIVYHGLVPQLGESGDSESTVHGEGSADVHQATHSHTSGRQTVMTEKSTFQSVVSESPQEDSAGDTSGAEMTSGVSRSFRHIRLGPTETETSEHIAIRGPVSRTFVLAGSADSPELGKLADSSRTLRHIAPGPKETSFTFQMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 821375 - protein, 1602 aa, Homo sapiens; identical to SEQ ID NO: 821374

SEQ ID NO: 821376 - protein, 1290 aa, Homo sapiens
ASGAAARPERRGGEDETGTRPGQEGAGQPREPRTPGKMLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAEALRREALGLEQLRARLEDALLRMREEYGIQAEERQRAIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSLKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 821377 - protein, 1290 aa, Homo sapiens; identical to SEQ ID NO: 821376

SEQ ID NO: 821378 - protein, 1226 aa, Homo sapiens
GLEDPLPLLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSLKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEVSAGGDLSQAASPTGASRSVRHVTLGPGQSPLSREVIFLGPAPACPEAWGSPEPGPAESSADMDGSGRHSTFGCRQFHAEKEIIFQGPISAAGKVGDYFATEESVGTQTSVRQLQLGPKEGFSGQIQFTAPLSDKVELGVIGDSVHMEGLPGSSTSIRHISIGPQRHQTTQQIVYHGLVPQLGESGDSESTVHGEGSADVHQATHSHTSGRQTVMTEKSTFQSVVSESPQEDSAGDTSGAEMTSGVSRSFRHIRLGPTETETSEHIAIRGPVSRTFVLAGSADSPELGKLADSSRTLRHIAPGPKETSFTFQMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 821379 - protein, 1209 aa, Homo sapiens
TTTKFAAASTSFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSLKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEVSAGGDLSQAASPTGASRSVRHVTLGPGQSPLSREVIFLGPAPACPEAWGSPEPGPAESSADMDGSGRHSTFGCRQFHAEKEIIFQGPISAAGKVGDYFATEESVGTQTSVRQLQLGPKEGFSGQIQFTAPLSDKVELGVIGDSVHMEGLPGSSTSIRHISIGPQRHQTTQQIVYHGLVPQLGESGDSESTVHGEGSADVHQATHSHTSGRQTVMTEKSTFQSVVSESPQEDSAGDTSGAEMTSGVSRSFRHIRLGPTETETSEHIAIRGPVSRTFVLAGSADSPELGKLADSSRTLRHIAPGPKETSFTFQMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 821380 - protein, 841 aa, Homo sapiens
MIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEVSAGGDLSQAASPTGASRSVRHVTLGPGQSPLSREVIFLGPAPACPEAWGSPEPGPAESSADMDGSGRHSTFGCRQFHAEKEIIFQGPISAAGKVGDYFATEESVGTQTSVRQLQLGPKEGFSGQIQFTAPLSDKVELGVIGDSVHMEGLPGSSTSIRHISIGPQRHQTTQQIVYHGLVPQLGESGDSESTVHGEGSADVHQATHSHTSGRQTVMTEKSTFQSVVSESPQEDSAGDTSGAEMTSGVSRSFRHIRLGPTETETSEHIAIRGPVSRTFVLAGSADSPELGKLADSSRTLRHIAPGPKETSFTFQMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 821381 - protein, 154 aa, Homo sapiens
MGNCLKSPTSDDISLLHESQSDRASFGEGTEPDQEPPPPYQEQVPVPVYHPTPSQTRLATQLTEEEQIRIAQRIGLIQHLPKGVYDPGRDGSEKKIRECVICMMDFVYGDPIRFLPCMHIYHLDCIDDWLMRSFTCPSCMEPVDAALLSSYETN

SEQ ID NO: 821382 - protein, 154 aa, Homo sapiens; identical to SEQ ID NO: 821381

SEQ ID NO: 821383 - protein, 154 aa, Homo sapiens; identical to SEQ ID NO: 821381

SEQ ID NO: 821384 - protein, 154 aa, Homo sapiens; identical to SEQ ID NO: 821381

SEQ ID NO: 821385 - protein, 152 aa, Homo sapiens
MTRPLGGTVGRWSRLRLIPGLSPDPTSPTEADRGVCERPHRCFLLPQITHPSSGRWGTASNPPPRMTSPCFTSLSPTGLALARGRSRIRSRRRHIRCVICMMDFVYGDPIRFLPCMHIYHLDCIDDWLMRSFTCPSCMEPVDAALLSSYETN

SEQ ID NO: 821386 - protein, 154 aa, Homo sapiens; identical to SEQ ID NO: 821381

SEQ ID NO: 821387 - protein, 154 aa, Homo sapiens; identical to SEQ ID NO: 821381

SEQ ID NO: 821388 - protein, 154 aa, Homo sapiens; identical to SEQ ID NO: 821381

SEQ ID NO: 821389 - protein, 154 aa, Homo sapiens; identical to SEQ ID NO: 821381

SEQ ID NO: 821390 - protein, 154 aa, Homo sapiens; identical to SEQ ID NO: 821381

SEQ ID NO: 821391 - protein, 148 aa, Homo sapiens
MGNCLKSPTSDDISLLHESQSDRASFGEGTEPDQEPPPPYQEQVPVPVYHPTPSQTRLATQLTEEEQIRIAQRIGLIQHLPKGVYDPGRDGSEKKIRECVICMMDFVYGDPIRFLPCMHIYHLDCIDDWLMRSFTCPSAALLSSYETN

SEQ ID NO: 821392 - protein, 707 aa, Homo sapiens
IFDFKVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETRKKMDALLQAASLGKLSANGLSGISLPEEATAMVGPPVKNGQETAVPPLWEKPPLGSSGCMLSPPLGRTTTGNLQGSLQNVSLSAPGNKQHKTLGAEPSQQPGSNETLRTTSQKAEPLCLGHFHNRHVFQQQLIEKQKKKLQEQQKTILELKKNLQLAEAQWAAEHALAVTEAQSHLLSKPREEEPRTCQMLVNSPVASPGTEGRSDSRNSLSGLRRKPKQLMTPHPILKAMEERAIQRAECRRILAEKKKKQEEEKLAQLKAQEEERQKREAEEKEAQLERKREEKRLKKMKELEKQKRIKRNQQLEAIAKEHYERVLLRKKGLEPWKRLRMQSKQNIQVAEEHYSLFLQRKYMLTWFQRSQESLARKMAQADQFYSQILLKRVIQSWLQYVIDLQEEVRKFCVHFLQKKIFRAWFNMVREVKIDSQGKHEIAAEHSDRRILWITLRTWKKFVKFMKEESSKRRKATATS

SEQ ID NO: 821393 - protein, 103 aa, Homo sapiens
MKELEKQKRIKRNQQLEAIAKEHYERVLLRKKGLEPWKRLRMQSKQNIQVAEEHYSLFLQRKYMLTWFQRSQESLARKMAQADQFYSQILLKRVIQSWLQVRT

SEQ ID NO: 821394 - protein, 240 aa, Homo sapiens
MEERAIQRAECRRILAEKKKKQEEEKLAQLKAQEEERQKREAEEKEAQLERKREEKRLKKMKELEKQKRIKRNQQLEAIAKEHYERVLLRKKGLEPWKRLRMQSKQNIQVAEEHYSLFLQRKYMLTWFQRSQESLARKMAQADQFYSQILLKRVIQSWLQYVIDLQEEVRKFCVHFLQKKIFRAWFNMVREVKIDSQGKHEIAAEHSDRRILWITLRTWKKFVKFMKEESSKRRKATATS

SEQ ID NO: 821395 - protein, 565 aa, Homo sapiens
MCFKVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETSGTAENNSRAEEKPAAGRGSVAAEHALAVTEAQSHLLSKPREEEPRTCQMLVNSPVASPGTEGRSDSRNSLSGLRRKPKQLMTPHPILKAMEERAIQRAECRRILAEKKKKQEEEKLAQLKAQEEERQKREAEEKEAQLERKREEKRLKKMKELEKQKRIKRNQQLEAIAKEHYERVLLRKKGLEPWKRLRMQSKQNIQVAEEHYSLFLQRKYMLTWFQRSQESLARKMAQADQFYSQILLKRVIQSWLQYVIDLQEEVRKFCVHFLQKKIFRAWFNMVREVKIDSQGKHEIAAEHSDRRILWITLRTWKKFVKFMKEESSKRRKATATS

SEQ ID NO: 821396 - protein, 482 aa, Homo sapiens
IFDFKVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETRKKMDALLQAASLGKLSANGLSGISLPEEATAMVGPPVKNGQETAVPPLWEKPPLGSSGCMLSPPLGRTTTGNLQGSLQNVSLSAPGNKQHKTLGAEPSQQPGSNETLRTTSQKAEPLCLGHFHNRHVFQQQLIEKQKKKLQEQQKTILELKKNLQLAEAQWAAEHALAVTEAQSHLLSKPREEEPRTCQMLVNSPVASPGTEGRSDSRNSLSGLRRKPKQLMTPHPILKGRAVLGGGLGGCYLLS

SEQ ID NO: 821397 - protein, 212 aa, Homo sapiens
IFDFKVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRNTLALVYEQSRPAYDAA

SEQ ID NO: 821398 - protein, 100 aa, Homo sapiens
ARRKMISSGRVNSRKVGSEMTVWEMVCTGSNTHVTSLGRQDLSTGSEGWSAAQPQVHLQAKSLLPVTVVCTCLYPQTFLMLGICSIRPTCIKLSQMNKSI

SEQ ID NO: 821399 - protein, 606 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821400 - protein, 606 aa, Homo sapiens; identical to SEQ ID NO: 821399

SEQ ID NO: 821401 - protein, 519 aa, Homo sapiens
SVGSARYERTARCLICYVNPKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821402 - protein, 448 aa, Homo sapiens
GTRGRPPQQTAMAAPLHKCGLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821403 - protein, 419 aa, Homo sapiens
TVATVFTRRKREILDVECAPADTDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821404 - protein, 333 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKGILWDPSAADPSYSARVALYKML

SEQ ID NO: 821405 - protein, 382 aa, Homo sapiens
MTFAKSTAIFHCHREVGQNDLVFKNWFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821406 - protein, 606 aa, Homo sapiens; identical to SEQ ID NO: 821399

SEQ ID NO: 821407 - protein, 372 aa, Homo sapiens
GDLEDAASKDITLKDIFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821408 - protein, 346 aa, Homo sapiens
QRKEPTVLMQDSPSRQLWLPVMHSLTSSQETPSDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821409 - protein, 606 aa, Homo sapiens; identical to SEQ ID NO: 821399

SEQ ID NO: 821410 - protein, 606 aa, Homo sapiens; identical to SEQ ID NO: 821399

SEQ ID NO: 821411 - protein, 606 aa, Homo sapiens; identical to SEQ ID NO: 821399

SEQ ID NO: 821412 - protein, 302 aa, Homo sapiens
LPLPTQATVQGSQSILTDKIGEAVMNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGVPLPGLRVP

SEQ ID NO: 821413 - protein, 606 aa, Homo sapiens; identical to SEQ ID NO: 821399

SEQ ID NO: 821414 - protein, 606 aa, Homo sapiens; identical to SEQ ID NO: 821399

SEQ ID NO: 821415 - protein, 606 aa, Homo sapiens; identical to SEQ ID NO: 821399

SEQ ID NO: 821416 - protein, 445 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHLREHAGLLPLQLFRGLPALCGWQVM

SEQ ID NO: 821417 - protein, 606 aa, Homo sapiens; identical to SEQ ID NO: 821399

SEQ ID NO: 821418 - protein, 606 aa, Homo sapiens; identical to SEQ ID NO: 821399

SEQ ID NO: 821419 - protein, 606 aa, Homo sapiens; identical to SEQ ID NO: 821399

SEQ ID NO: 821420 - protein, 606 aa, Homo sapiens; identical to SEQ ID NO: 821399

SEQ ID NO: 821421 - protein, 606 aa, Homo sapiens; identical to SEQ ID NO: 821399

SEQ ID NO: 821422 - protein, 606 aa, Homo sapiens; identical to SEQ ID NO: 821399

SEQ ID NO: 821423 - protein, 606 aa, Homo sapiens; identical to SEQ ID NO: 821399

SEQ ID NO: 821424 - protein, 606 aa, Homo sapiens; identical to SEQ ID NO: 821399

SEQ ID NO: 821425 - protein, 597 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIRRQ

SEQ ID NO: 821426 - protein, 582 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQGEQEGCPGV

SEQ ID NO: 821427 - protein, 580 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIYECVT

SEQ ID NO: 821428 - protein, 610 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDERVTPCPTLKPKAVIWFVMCLSGLETKPLQERRT

SEQ ID NO: 821429 - protein, 67 aa, Homo sapiens
ADLEDPYSENIIKRYMDGMTVGVVRQVRPIVGPFHAVLKLEMNYVVGGVVSHRNVVNVHIFVSEYWF

SEQ ID NO: 821430 - protein, 498 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEEGAAGAPST

SEQ ID NO: 821431 - protein, 100 aa, Homo sapiens; identical to SEQ ID NO: 821398

SEQ ID NO: 821432 - protein, 120 aa, Homo sapiens
STDVKREEPDLISPTSKTPSEQQRPQHPPRTGDSIFTATPCGGRLTTSHHIIPELSSSSGMTPSPPPPSSSFSSFWLQAGPPGRNCQDIDECVTGIHNCSINETCFNIQGGVPLPGLRVP

SEQ ID NO: 821433 - protein, 476 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVDERPRYPGACVALRARHAAPPTPPVRD

SEQ ID NO: 821434 - protein, 468 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQQLRPGACVHRYTPYE

SEQ ID NO: 821435 - protein, 374 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIGKRCAARISGLFQEGSAT

SEQ ID NO: 821436 - protein, 329 aa, Homo sapiens
LLPGGIIERRGPGPALAAEARPERGARAAAPGPRPRLCPPPPTARRPPPMERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQ

SEQ ID NO: 821437 - protein, 242 aa, Homo sapiens
MKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821438 - protein, 385 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKVSLGEGRPPVLTASRQGVTST

SEQ ID NO: 821439 - protein, 385 aa, Homo sapiens; identical to SEQ ID NO: 821438

SEQ ID NO: 821440 - protein, 357 aa, Homo sapiens
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKVSLGEGRPPVLTASRQGVTST

SEQ ID NO: 821441 - protein, 104 aa, Homo sapiens
RPPARPPGSLIPVSTIPPSVVCLLGTTPWGGPRLSLGPGSERGWRGGIDGQRGPRPSQRRFQLRELPPVRVPRMASGRRGGWAYRQLAGRRGLDFAKRFTEPSF

SEQ ID NO: 821442 - protein, 659 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821443 - protein, 431 aa, Homo sapiens
MLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821444 - protein, 673 aa, Homo sapiens
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821445 - protein, 631 aa, Homo sapiens
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821446 - protein, 659 aa, Homo sapiens; identical to SEQ ID NO: 821442

SEQ ID NO: 821447 - protein, 631 aa, Homo sapiens; identical to SEQ ID NO: 821445

SEQ ID NO: 821448 - protein, 659 aa, Homo sapiens; identical to SEQ ID NO: 821442

SEQ ID NO: 821449 - protein, 659 aa, Homo sapiens; identical to SEQ ID NO: 821442

SEQ ID NO: 821450 - protein, 643 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGQRWHCSSTWHDGSAPGHLRASHLLV

SEQ ID NO: 821451 - protein, 631 aa, Homo sapiens; identical to SEQ ID NO: 821445

SEQ ID NO: 821452 - protein, 520 aa, Homo sapiens
MALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821453 - protein, 642 aa, Homo sapiens
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 821454 - protein, 631 aa, Homo sapiens; identical to SEQ ID NO: 821445

SEQ ID NO: 821455 - protein, 385 aa, Homo sapiens; identical to SEQ ID NO: 821438

SEQ ID NO: 821456 - protein, 385 aa, Homo sapiens; identical to SEQ ID NO: 821438

SEQ ID NO: 821457 - protein, 385 aa, Homo sapiens; identical to SEQ ID NO: 821438

SEQ ID NO: 821458 - protein, 246 aa, Homo sapiens [sequence omitted]

SEQ ID NO: 821459 - protein, 385 aa, Homo sapiens; identical to SEQ ID NO: 821438

SEQ ID NO: 821460 - protein, 385 aa, Homo sapiens; identical to SEQ ID NO: 821438

SEQ ID NO: 821461 - protein, 385 aa, Homo sapiens; identical to SEQ ID NO: 821438

SEQ ID NO: 821462 - protein, 246 aa, Homo sapiens [sequence omitted]

SEQ ID NO: 821463 - protein, 385 aa, Homo sapiens; identical to SEQ ID NO: 821438

SEQ ID NO: 821464 - protein, 385 aa, Homo sapiens; identical to SEQ ID NO: 821438

SEQ ID NO: 821465 - protein, 385 aa, Homo sapiens; identical to SEQ ID NO: 821438

SEQ ID NO: 821466 - protein, 385 aa, Homo sapiens; identical to SEQ ID NO: 821438

SEQ ID NO: 821467 - protein, 385 aa, Homo sapiens; identical to SEQ ID NO: 821438

SEQ ID NO: 821468 - protein, 127 aa, Homo sapiens
GRVGRPTRRQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNV

SEQ ID NO: 821469 - protein, 119 aa, Homo sapiens
ISFLLIGLLSPDLKFIEACLRCLRTIFTSPVTPEELLYTGPDHQTILFNHGAVQNIAHLLTSLSYKLDHDLKHAHELRQAAFKLYASLGANDEDIRKKVSLGEGRPPVLTASRQGVTST

SEQ ID NO: 821470 - protein, 192 aa, Homo sapiens [sequence omitted]

SEQ ID NO: 821471 - protein, 195 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKVRTRINVIYNVKSYYAFKRCTFFVYPPGVVIHI

SEQ ID NO: 821472 - protein, 137 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTVSFRCI

SEQ ID NO: 821473 - protein, 24 aa, Homo sapiens
MENERLIMLSGEFDAKVGETEKRR

SEQ ID NO: 821474 - protein, 190 aa, Homo sapiens
YTFRYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 821475 - protein, 190 aa, Homo sapiens; identical to SEQ ID NO: 821474

SEQ ID NO: 821476 - protein, 190 aa, Homo sapiens; identical to SEQ ID NO: 821474

SEQ ID NO: 821477 - protein, 190 aa, Homo sapiens; identical to SEQ ID NO: 821474

SEQ ID NO: 821478 - protein, 135 aa, Homo sapiens
YTFRYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKILKEPITRLKRQLISVIFQMMRSQ

SEQ ID NO: 821479 - protein, 21 aa, Homo sapiens
MKLMTVDPVVQEATLHVSSRL

SEQ ID NO: 821480 - protein, 21 aa, Homo sapiens
MKLMTVDPVVQEATLHVSSRL

SEQ ID NO: 821481 - protein, 21 aa, Homo sapiens
MKLMTVDPVVQEATLHVSSRL

SEQ ID NO: 821482 - protein, 21 aa, Homo sapiens
MKLMTVDPVVQEATLHVSSRL

SEQ ID NO: 821483 - protein, 476 aa, Homo sapiens
AGPGSEGVRGLSGSCPGCSPLEPGSRGRGAAAWRILRCRRLPEPSPFLTQPNLAQSQPPAPVPVTDPSVTMHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 821484 - protein, 168 aa, Homo sapiens
AGPGSEGVRGLSGSCPGCSPLEPGSRGRGAAAWRILRCRRLPEPSPFLTQPNLAQSQPPAPVPVTDPSVTMHPAVFLSLPDLRCSLLLLVTWVFTPVTTEITSLDTENIDEILNNADVALVNFYADWCRFSQMLHPIFEEASDVIKEEFPNENQVVFARVDCDQHFWT

SEQ ID NO: 821485 - protein, 349 aa, Homo sapiens
AGPGSEGVRGLSGSCPGCSPLEPGSRGRGAAAWRILRCRRLPEPSPFLTQPNLAQSQPPAPVPVTDPSVTMHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELPKKDCFLILFPERRSDVAIFRMK

SEQ ID NO: 821486 - protein, 306 aa, Homo sapiens
AGPGSEGVRGLSGSCPGCSPLEPGSRGRGAAAWRILRCRRLPEPSPFLTQPNLAQSQPPAPVPVTDPSVTMHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGTTLWHWVLRFG

SEQ ID NO: 821487 - protein, 490 aa, Homo sapiens
AGPGSEGVRGLSGSCPGCSPLEPGSRGRGAAAWRILRCRRLPEPSPFLTQPNLAQSQPPAPVPVTDPSVTMHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGSYEQKFFVELFGTFNKIVGISKGLKMLFPFVVPEKITFGKMGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 821488 - protein, 406 aa, Homo sapiens
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 821489 - protein, 369 aa, Homo sapiens
MLPSAPDNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 821490 - protein, 338 aa, Homo sapiens
AGPGSEGVRGLSGSCPGCSPLEPGSRGRGAAAWRILRCRRLPEPSPFLTQPNLAQSQPPAPVPVTDPSVTMHPAVFLSLPDLRCSLLLLRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 821491 - protein, 157 aa, Homo sapiens
MQLTVKALQGRECSLQVPEDELVSTLKQLVSEKLNVPVRQQRLLFKGKALADGKRLSDYSIGPNSKLNLVVKPLEKVLLEEGEAQRLADSPPPQVWQLISKVLARHFSAADASRVLEQLQRDYERSLSRLTLDDIERLASRFLHPEVTETMEKGFSK

SEQ ID NO: 821492 - protein, 157 aa, Homo sapiens; identical to SEQ ID NO: 821491

SEQ ID NO: 821493 - protein, 146 aa, Homo sapiens
GRMPHSRMPQRSAPAARGGLAPRATPTAVEEEEPIDLSLADGKRLSDYSIGPNSKLNLVVKPLEKVLLEEGEAQRLADSPPPQVWQLISKVLARHFSAADASRVLEQLQRDYERSLSRLTLDDIERLASRFLHPEVTETMEKGFSK

SEQ ID NO: 821494 - protein, 157 aa, Homo sapiens; identical to SEQ ID NO: 821491

SEQ ID NO: 821495 - protein, 157 aa, Homo sapiens; identical to SEQ ID NO: 821491

SEQ ID NO: 821496 - protein, 180 aa, Homo sapiens [sequence omitted]

SEQ ID NO: 821497 - protein, 159 aa, Homo sapiens
MPQRSAPAARGGLAPRATPTAVEEEEPIDLSLADGKRLSDYSIGPNSKLNLVVKPLEKVLLEEGEAQRLADSPPPQVWQLISKVLARHFSAADASRVLEQLQRVRRVTLGILFRPSCSQPLPLLQCMPPPHWQPLNLPALLSPGLREVPESPDAGRHRT

SEQ ID NO: 821498 - protein, 113 aa, Homo sapiens
MEREGSGGSGGSAGLLQQILSLKVVPRVGNGTLCPNSTSLCSFPEMWYGVFLWALVSSLFFHVPAGLLALFTLRHHKYGRFMSVSILLMGIVGPITAGILTSMLDIKIPVKNV

SEQ ID NO: 821499 - protein, 97 aa, Homo sapiens
GTRGSRCPSRDFPGRDCEVAEMWYGVFLWALVSSLFFHVPAGLLALFTLRHHKYGAAIAGVYRAAGKEMIPFEALTLGTGQTFCVLVVSFLRILATL

SEQ ID NO: 821500 - protein, 200 aa, Homo sapiens
MEREGSGGSGGSAGLLQQILSLKVVPRVGNGTLCPNSTSLCSFPGTARPAPAHCAPRRRRCRAVGAPSLGGVPGAQPAGGVGRCPPGGGPCCSPGAPFPITSSAVPEAEPRSPAGREMQRAAAEMWYGVFLWALVSSLFFHVPAGLLALFTLRHHKYGAAIAGVYRAAGKEMIPFEALTLGTGQTFCVLVVSFLRILATL

SEQ ID NO: 821501 - protein, 97 aa, Homo sapiens; identical to SEQ ID NO: 821499

SEQ ID NO: 821502 - protein, 223 aa, Homo sapiens
MEREGSGGSGGSAGLLQQILSLKVVPRVGNGTLCPNSTSLCSFPGTARPAPAHCAPRRRRCRAVGAPSLGGVPGAQPAGGVGRCPPGGGPCCSPGAPFPITSSAVPEAEPRSPAGREMQRAAAEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 821503 - protein, 132 aa, Homo sapiens
LSNYHRYRLSEGRRPSWADCLSRGIQDQPGQHEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 821504 - protein, 144 aa, Homo sapiens
MEREGSGGSGGSAGLLQQILSLKVVPRVGNGTLCPNSTSLCSFPEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 821505 - protein, 107 aa, Homo sapiens
MQFPTFSQGALQRRAEQSARSQSAPSRRGRVRGAVSLRALRNVGGGNNPGPAPERCGALGLEEATVTWQRRWDWGKRTPAGGDAEAARVSRRRPLPHFGRSSLISLW

SEQ ID NO: 821506 - protein, 97 aa, Homo sapiens; identical to SEQ ID NO: 821499

SEQ ID NO: 821507 - protein, 521 aa, Homo sapiens
MNSSLGHRARPCLKIILLILELTYQNYSDIYTEQKLISRVVMQPNILTNSLTRSSNLSHRQIVKILVFCLKSCDFQKYPFSLRNLGNWKLFLWEMIAIISTEEMPLTEKCLLKEFLPKAFFGCNFIHLTYRPVVSGPLLLNSNFEVLNMIKMLDIFHWSSDLKLGHFERCICFCFLFDIFWLSTLLKTKRIKGIFKLLSVSSIPVGEVFSSEVNLYIYIDFKKLERCSLKCFQGKTIRIIRNSFDFLFYVSNIELFGGGHSDGRILAIVLNILPYIVLRIFAKTDFLEISSPSCALVFWFFCFETESCSVAQAGVQWHDLGSLQALPPGFTPFSCLSLPSSWDYGRPPPCPANFLYFVVETGFHRVSQDGLNLLTRLHLPKCWDYRHEPPHPASALFFKKKEMQEREGGSLLTIKADFLIFFSFFFEMESCSVSKAGVQWHGLSSLQPPFLGSSDCPALAAGVARITGTRHKAQLIFVFLVETGFDYVGQAGLKLLTSSDPPASASQRDGTIDMSHRAWPS

SEQ ID NO: 821508 - protein, 1374 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 821509 - protein, 1356 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDIKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 821510 - protein, 1353 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFHSDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 821511 - protein, 223 aa, Homo sapiens
MFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 821512 - protein, 966 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHGQSDSSPGHKGTLQYMAPEIIDKGPRGYGKAADIWSLGCTIIEMATGKPPLLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 821513 - protein, 479 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGNYNLIFYMEIKKLDPTWCKEKES

SEQ ID NO: 821514 - protein, 474 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASCIAVVEMNDAFRQPSLFYHLGVRESFSMANNIILYCDTNSDSLQVTEDCNFLAGKDR

SEQ ID NO: 821515 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 821516 - protein, 798 aa, Homo sapiens; identical to SEQ ID NO: 821515

SEQ ID NO: 821517 - protein, 798 aa, Homo sapiens; identical to SEQ ID NO: 821515

SEQ ID NO: 821518 - protein, 798 aa, Homo sapiens; identical to SEQ ID NO: 821515

SEQ ID NO: 821519 - protein, 197 aa, Homo sapiens [sequence omitted]

SEQ ID NO: 821520 - protein, 650 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 821521 - protein, 493 aa, Homo sapiens
LQSQCPSLGMKMPLQSQHRVDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 821522 - protein, 208 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGEPSAASRPVSPCLFNH

SEQ ID NO: 821523 - protein, 219 aa, Homo sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPDVCQASNLLPALRSLNCCLPSSL

SEQ ID NO: 821524 - protein, 332 aa, Homo sapiens
MKISRGRVCLESENKDAGVAGRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 821525 - protein, 372 aa, Homo sapiens
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 821526 - protein, 354 aa, Homo sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 821527 - protein, 331 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 821528 - protein, 331 aa, Homo sapiens; identical to SEQ ID NO: 821527

SEQ ID NO: 821529 - protein, 331 aa, Homo sapiens; identical to SEQ ID NO: 821527

SEQ ID NO: 821530 - protein, 331 aa, Homo sapiens; identical to SEQ ID NO: 821527

SEQ ID NO: 821531 - protein, 331 aa, Homo sapiens; identical to SEQ ID NO: 821527

SEQ ID NO: 821532 - protein, 331 aa, Homo sapiens; identical to SEQ ID NO: 821527

SEQ ID NO: 821533 - protein, 331 aa, Homo sapiens; identical to SEQ ID NO: 821527

SEQ ID NO: 821534 - protein, 331 aa, Homo sapiens; identical to SEQ ID NO: 821527

SEQ ID NO: 821535 - protein, 308 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSDGVLLCCQAGVRWHDLSSLQPLPPGFKQFSCLSLLSSWDYRCLL

SEQ ID NO: 821536 - protein, 331 aa, Homo sapiens; identical to SEQ ID NO: 821527

SEQ ID NO: 821537 - protein, 175 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTVHH

SEQ ID NO: 821538 - protein, 220 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMVSTMNHPVLRM

SEQ ID NO: 821539 - protein, 321 aa, Homo sapiens
MVARASELHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 821540 - protein, 331 aa, Homo sapiens; identical to SEQ ID NO: 821527

SEQ ID NO: 821541 - protein, 313 aa, Homo sapiens
MKRLVCVLLVCSSAVAQLHKDPTLDHHWHLWKKTYGKQYKEKNEEAVRRLIWDSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 821542 - protein, 134 aa, Homo sapiens
PRVRPTRRYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 821543 - protein, 331 aa, Homo sapiens; identical to SEQ ID NO: 821527

SEQ ID NO: 821544 - protein, 129 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITPLYSSLDDRVETLFQKNRKENIV

SEQ ID NO: 821545 - protein, 225 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMISVNMTQKSEEAVAMA

SEQ ID NO: 821546 - protein, 141 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQVSITIPSL

SEQ ID NO: 821547 - protein, 134 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGVAVVSDPLE

SEQ ID NO: 821548 - protein, 328 aa, Homo sapiens
MLPRVGCPALPLPPPPLLPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 821549 - protein, 249 aa, Homo sapiens
RKKRRRRLPRSQGRATCPPARSLARPPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 821550 - protein, 328 aa, Homo sapiens; identical to SEQ ID NO: 821548

SEQ ID NO: 821551 - protein, 328 aa, Homo sapiens; identical to SEQ ID NO: 821548

SEQ ID NO: 821552 - protein, 317 aa, Homo sapiens
MLPRVGCPALPLPPPPLLPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCWCVNPNTGKLIQGAPTIRGDPECHLFYNEQQEARGVHTQRMQ

SEQ ID NO: 821553 - protein, 328 aa, Homo sapiens; identical to SEQ ID NO: 821548

SEQ ID NO: 821554 - protein, 328 aa, Homo sapiens; identical to SEQ ID NO: 821548

SEQ ID NO: 821555 - protein, 317 aa, Homo sapiens; identical to SEQ ID NO: 821552

SEQ ID NO: 821556 - protein, 280 aa, Homo sapiens
MLPRVGCPALPLPPPPLLPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQVSMVPA

SEQ ID NO: 821557 - protein, 181 aa, Homo sapiens
MPCNNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 821558 - protein, 77 aa, Homo sapiens
MQAQQYQQQRRKFAAAFLAFIFILAAVDTAEAGKKEKPGNQKKKVRVLLWECMDFFSHHGSWSAQGAMAGLIQPPWP

SEQ ID NO: 821559 - protein, 168 aa, Homo sapiens
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 821560 - protein, 168 aa, Homo sapiens; identical to SEQ ID NO: 821559

SEQ ID NO: 821561 - protein, 168 aa, Homo sapiens; identical to SEQ ID NO: 821559

SEQ ID NO: 821562 - protein, 101 aa, Homo sapiens
LQDSARVNTSLLLSSSWKPSRLPCSSPLCSSSACCRRGSTSSKPEEPPASRALEAPEAASSSKSRESFLPIFTVSQLTSSSPSSLSLSESRSLSDSALAVV

SEQ ID NO: 821563 - protein, 163 aa, Homo sapiens
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECLKTRTGSLKRALHNAECQKTVTISKPCGKLTKPKPQAESKKKKKEGKKQEKMLD

SEQ ID NO: 821564 - protein, 75 aa, Homo sapiens
WIVNEEEHITGLFPLNDLNTALKTRTGSLKRALHNAECQKTVTISKPCGKLTKPKPQAESKKKKKEGKKQEKMLD

SEQ ID NO: 821565 - protein, 222 aa, Homo sapiens
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKDAKLALIKEKIKNRYFPAFEKVLKSHGQDYLVGNKLSRADIHLVELLYYVEELDSSLISSFPLLKALKTRISNLPTVKKFLQPGSPRKPPMDEKSLEEARKIFRF

SEQ ID NO: 821566 - protein, 222 aa, Homo sapiens; identical to SEQ ID NO: 821565

SEQ ID NO: 821567 - protein, 222 aa, Homo sapiens; identical to SEQ ID NO: 821565

SEQ ID NO: 821568 - protein, 192 aa, Homo sapiens
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKDAKLALIKEKIKNRYFPAFEKVLKSHGQDYLVGNKLSRADIHLVELLYYVEELDSSLISSFPLLKAWQPKEASHG

SEQ ID NO: 821569 - protein, 139 aa, Homo sapiens
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKDAKLALIKEKIKNRYFPAFEKG

SEQ ID NO: 821570 - protein, 139 aa, Homo sapiens; identical to SEQ ID NO: 821569

SEQ ID NO: 821571 - protein, 222 aa, Homo sapiens; identical to SEQ ID NO: 821565

SEQ ID NO: 821572 - protein, 139 aa, Homo sapiens; identical to SEQ ID NO: 821569

SEQ ID NO: 821573 - protein, 228 aa, Homo sapiens
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKDAKLALIKEKIKNRYFPAFEKVLKSHGQDYLVGNKLSRADIHLVELLYYVEELDSSLISSFPLLKLSRTLAPHTVSLTEKRWSHGPENQNQQPAHSEEVSTAWQPKEASHG

SEQ ID NO: 821574 - protein, 172 aa, Homo sapiens
MFQQVPMVEIDGMKLVQTRAILNYIASKYNLYGKDIKERALIDMYIEGIADLGEMILLLPVCPPEEKDAKLALIKEKIKNRYFPAFEKVLKSHGQDYLVGNKLSRADIHLVELLYYVEELDSSLISSFPLLKALKTRISNLPTVKKFLQPGSPRKPPMDEKSLEEARKIFRF

SEQ ID NO: 821575 - protein, 129 aa, Homo sapiens
MYIEGIADLGEMILLLPVCPPEEKDAKLALIKEKIKNRYFPAFEKVLKSHGQDYLVGNKLSRADIHLVELLYYVEELDSSLISSFPLLKALKTRISNLPTVKKFLQPGSPRKPPMDEKSLEEARKIFRF

SEQ ID NO: 821576 - protein, 139 aa, Homo sapiens; identical to SEQ ID NO: 821569

SEQ ID NO: 821577 - protein, 157 aa, Homo sapiens
MYIEGIADLGEMILLLPVCPPEEKDAKLALIKEKIKNRYFPAFEKVLKSHGQDYLVGNKLSRADIHLVELLYYVEELDSSLISSFPLLKALKTRISNLPTVKKFLQPGSPRKPPMDEKSLEEARSNTNVLKFCNNKVLYLSVDCACCEANELFQIIC

SEQ ID NO: 821578 - protein, 1022 aa, Homo sapiens
SSETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 821579 - protein, 962 aa, Homo sapiens
MLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 821580 - protein, 937 aa, Homo sapiens [sequence omitted]

SEQ ID NO: 821581 - protein, 877 aa, Homo sapiens
LSPGGGPAAKAHVGGAPPLLPDPSLTSCPLCSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 821582 - protein, 134 aa, Homo sapiens [sequence omitted]

SEQ ID NO: 821583 - protein, 159 aa, Homo sapiens
MLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVRYVPSLTWGLSRESGGPIELFFSMKMKSLRSNEKSSSSCTVNI

SEQ ID NO: 821584 - protein, 568 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 821585 - protein, 145 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSR

SEQ ID NO: 821586 - protein, 568 aa, Homo sapiens; identical to SEQ ID NO: 821584

SEQ ID NO: 821587 - protein, 568 aa, Homo sapiens; identical to SEQ ID NO: 821584

SEQ ID NO: 821588 - protein, 568 aa, Homo sapiens; identical to SEQ ID NO: 821584

SEQ ID NO: 821589 - protein, 242 aa, Homo sapiens
SRGSPVRTILNQFNPFYEAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 821590 - protein, 556 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQIKICQSSIFWLNLGMWFLNSHSVSKSVFPYRMWKLFLHTL

SEQ ID NO: 821591 - protein, 184 aa, Homo sapiens
MDIAKRNGLFIMSFFCIGVSNLNVLRNFTYVMTGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 821592 - protein, 555 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKK

SEQ ID NO: 821593 - protein, 559 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKFILCL

SEQ ID NO: 821594 - protein, 401 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVIEVRPMQVAAIITPKNCSS

SEQ ID NO: 821595 - protein, 299 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHP

SEQ ID NO: 821596 - protein, 213 aa, Homo sapiens
MLPGLAAAAAHRCSWSSLCRLRLRCRAAACNPSDRQEWQNLVTFGSFSNVVPCSHPYIGTLSQVKLYSTNVQKEGQGSQTLRVEKVPSFETAEGIGAELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERPQQNGETHF

SEQ ID NO: 821597 - protein, 203 aa, Homo sapiens
ETSLELSPTDLSFTGIQTVMFETVYLRRSRDSPSSPKAHCNWPSAPFKLDFWFLLSFCPWILKSFFLRSFCRFSFSSSSFCLALKCSLFAGGYATCRLFDLRADQELMTYSHDNIICGITSVSFSKSGRLLLAGYDDFNCNVWDALKADRAGTWPWGLSVSCGHLRGIFRANTEWLHKLQCFSIGGTVAWRSRSDSRKLMAQL

SEQ ID NO: 821598 - protein, 115 aa, Homo sapiens
KGITTWNIMPRVNRKGSCKEHRSSMYGCAGINVAHKEPSKRSGQSRNGYNCKRLFLKRKRTPKDCLPYWVGLLLESHAVEMLKSAYGTQSSVLEHFTRRVYISQIAVPAALKKNP

SEQ ID NO: 821599 - protein, 340 aa, Homo sapiens [sequence omitted]

SEQ ID NO: 821600 - protein, 340 aa, Homo sapiens [sequence omitted]

SEQ ID NO: 821601 - protein, 340 aa, Homo sapiens [sequence omitted]

SEQ ID NO: 821602 - protein, 340 aa, Homo sapiens [sequence omitted]

SEQ ID NO: 821603 - protein, 327 aa, Homo sapiens
MSELDQLRQEAEQLKNQIRITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDGMAVATGSWDSFLKIWN

SEQ ID NO: 821604 - protein, 382 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKPRHPSALLAKIYAMHWGKTPGFSSVPRRMVNLSSGTATPPNKVHAIPLRSSWVMTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDGMAVATGSWDSFLKIWN

SEQ ID NO: 821605 - protein, 340 aa, Homo sapiens [sequence omitted]

SEQ ID NO: 821606 - protein, 264 aa, Homo sapiens
RGSPIVQRGRWDKFTCIGDQTRSPSELRYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDGMAVATGSWDSFLKIWN

SEQ ID NO: 821607 - protein, 340 aa, Homo sapiens [sequence omitted]

SEQ ID NO: 821608 - protein, 340 aa, Homo sapiens [sequence omitted]

SEQ ID NO: 821609 - protein, 340 aa, Homo sapiens [sequence omitted]

SEQ ID NO: 821610 - protein, 340 aa, Homo sapiens [sequence omitted]

SEQ ID NO: 821611 - protein, 409 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDACGCHGDWKTIPTWTRYHESISYPTVLTWTPYTSPQNFKRARSFFLHLLLKPRAQFPLRERSLCCKLKQIVHSFRGHRLCFLFCLE

SEQ ID NO: 821612 - protein, 340 aa, Homo sapiens [sequence omitted]

SEQ ID NO: 821613 - protein, 340 aa, Homo sapiens [sequence omitted]

SEQ ID NO: 821614 - protein, 340 aa, Homo sapiens [sequence omitted]

SEQ ID NO: 821615 - protein, 340 aa, Homo sapiens [sequence omitted]

SEQ ID NO: 821616 - protein, 340 aa, Homo sapiens [sequence omitted]

SEQ ID NO: 821617 - protein, 340 aa, Homo sapiens [sequence omitted]

SEQ ID NO: 821618 - protein, 340 aa, Homo sapiens [sequence omitted]

SEQ ID NO: 821619 - protein, 340 aa, Homo sapiens [sequence omitted]

SEQ ID NO: 821620 - protein, 340 aa, Homo sapiens [sequence omitted]

SEQ ID NO: 821621 - protein, 340 aa, Homo sapiens [sequence omitted]

SEQ ID NO: 821622 - protein, 340 aa, Homo sapiens [sequence omitted]

SEQ ID NO: 821623 - protein, 340 aa, Homo sapiens [sequence omitted]

SEQ ID NO: 821624 - protein, 357 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGTWPWGLSVSCGHLRGIFRANTEWLHKLQCFSIGGTVAWRSRSDSRKLMAQL

SEQ ID NO: 821625 - protein, 272 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFNGKHCHWLDEAPARCLTLGDRIRYQNIGENGYKGTWE

SEQ ID NO: 821626 - protein, 151 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTARQLPGRD

SEQ ID NO: 821627 - protein, 1241 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821628 - protein, 1227 aa, Homo sapiens
MTQPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821629 - protein, 998 aa, Homo sapiens [sequence omitted]

SEQ ID NO: 821630 - protein, 1241 aa, Homo sapiens; identical to SEQ ID NO: 821627

SEQ ID NO: 821631 - protein, 1241 aa, Homo sapiens; identical to SEQ ID NO: 821627

SEQ ID NO: 821632 - protein, 1236 aa, Homo sapiens
PLPAMDFLLRPQPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821633 - protein, 1294 aa, Homo sapiens
MSSAPRRPAKGADSFCTPEPESLGPGTPGFPEQEEDELHRTLGVERFEEILQEAGSRGGEEPGRSYGEEDFECEGAGRGGGGGGIRFDLSSKEGTGVLVGGVGLGGRMAGEGHCACHSQVPLLPADHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821634 - protein, 998 aa, Homo sapiens [sequence omitted]

SEQ ID NO: 821635 - protein, 1241 aa, Homo sapiens; identical to SEQ ID NO: 821627

SEQ ID NO: 821636 - protein, 1241 aa, Homo sapiens; identical to SEQ ID NO: 821627

SEQ ID NO: 821637 - protein, 1241 aa, Homo sapiens; identical to SEQ ID NO: 821627

SEQ ID NO: 821638 - protein, 1211 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821639 - protein, 722 aa, Homo sapiens
GTLVFTAVHKGDSGQYYCIASNDAGSARCEQQEEDVLLLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821640 - protein, 719 aa, Homo sapiens
ETESHSVTQAGVQWHDLGSLQPPPPRFKQFSCLSLLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821641 - protein, 667 aa, Homo sapiens
SPIPMLLWQQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821642 - protein, 1320 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVSPPAPHRKGCASGHPGLLGSLSSCPLPSAQFSQPPPPLCTNPALAPRNVLPSPPPKKREALPSSRLGRKLGSPVSAPQVRTLRMHLFTALQLLCLALLWAVMSTAASLAFPFILILTVPLRMVVLTRIFTDREMKCLDANEAEPVFDEREGVDEYNEMPMPV

SEQ ID NO: 821643 - protein, 1251 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCVSPPVCLPRFLLPPCGSGKAPPLPFLTATSPHTAGC

SEQ ID NO: 821644 - protein, 1330 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVSPPAPHRKGCASGHPGLLGSLSSCPLPSAQFSQPPPPLCTNPALAPRNVLPSPPPKKREALPSSRLGRKLGSPVSAPQVRTLRMHLFTALQLLCLALLWAVMSTAASLAFPFILILTVPLRMVVLTRIFTDREMKCVSPPVCLPRFLLPPCGSGKAPPLPFLTATSPHTAGC

SEQ ID NO: 821645 - protein, 1216 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVPDLRMPWSRPAGVLLAWSGPALHSLLPGLPLISSHSAVRWCVTQFFRRKMKLVLPGTG

SEQ ID NO: 821646 - protein, 842 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYPAVAGAHGRHLLHRLLPAQIQEQPVLSWPDPAGDWGLWGAHRHPHHGACGLQY

SEQ ID NO: 821647 - protein, 411 aa, Homo sapiens
MSQSPGCKFQYQGEEIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 821648 - protein, 373 aa, Homo sapiens [sequence omitted]

SEQ ID NO: 821649 - protein, 471 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHRREDTGPDRGVGADYVHSAPGRGLLPAGCPAPVGDRLLRAPAGL

SEQ ID NO: 821650 - protein, 127 aa, Homo sapiens
NTALLSLVLMAGTFFIAFFLRKFKNSRFFPGRVRGLKGQEGVRGRKGGGRKSAAVVAGLWALCLPTQIRRVIGDFGVPIAILIMVLVDYSIEDTYTQVRCCPQQASAAASATPGLGVPLQPPNPACP

SEQ ID NO: 821651 - protein, 736 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 821652 - protein, 736 aa, Homo sapiens; identical to SEQ ID NO: 821651

SEQ ID NO: 821653 - protein, 736 aa, Homo sapiens; identical to SEQ ID NO: 821651

SEQ ID NO: 821654 - protein, 736 aa, Homo sapiens; identical to SEQ ID NO: 821651

SEQ ID NO: 821655 - protein, 736 aa, Homo sapiens; identical to SEQ ID NO: 821651

SEQ ID NO: 821656 - protein, 736 aa, Homo sapiens; identical to SEQ ID NO: 821651

SEQ ID NO: 821657 - protein, 736 aa, Homo sapiens; identical to SEQ ID NO: 821651

SEQ ID NO: 821658 - protein, 736 aa, Homo sapiens; identical to SEQ ID NO: 821651

SEQ ID NO: 821659 - protein, 736 aa, Homo sapiens; identical to SEQ ID NO: 821651

SEQ ID NO: 821660 - protein, 608 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKES

SEQ ID NO: 821661 - protein, 345 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 821662 - protein, 377 aa, Homo sapiens
VPETVNLEDPERETSVERRRTCAFDTLEAFLIMDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 821663 - protein, 345 aa, Homo sapiens; identical to SEQ ID NO: 821661

SEQ ID NO: 821664 - protein, 328 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGQEKVIFPTLFMGQ

SEQ ID NO: 821665 - protein, 347 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVAATGPCPAPELCAISILAIFSSRRSAVGFT

SEQ ID NO: 821666 - protein, 345 aa, Homo sapiens; identical to SEQ ID NO: 821661

SEQ ID NO: 821667 - protein, 345 aa, Homo sapiens; identical to SEQ ID NO: 821661

SEQ ID NO: 821668 - protein, 285 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGVSFNYLSLGVSTDKVLNYFLI

SEQ ID NO: 821669 - protein, 235 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKGL

SEQ ID NO: 821670 - protein, 474 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 821671 - protein, 186 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGSTLGGPGGEAPARSRRHRVGPGPPGWA

SEQ ID NO: 821672 - protein, 668 aa, Homo sapiens
MFPRVSLIPKGKLFIKVRISSTSASEPFWEAYCVRRGPSAADGEAGGRGRPGKLGVCRVWVRQSGAFRATVPMGMSCPQRGLAPGGSRREPGLPGAPAPAPGLPGPPGCAFGSRAPLRGGSTARDGTVRQPGRALPPLGELVWAAASGDDPFHSRGAVVSLVPRPPPVFRRSVSSGPCSPSPQRSVVVAADEFRFRLLPPLAGGESGESAQFARRLGASLSSHFVVAAARGPGLPLTPLLGDGAAQGRLHPPPLPLTRVPHSMAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 821673 - protein, 625 aa, Homo sapiens
MAGGRGRPGKLGVCRVWVRQSGAFRATVPMGMSCPQRGLAPGGSRREPGLPGAPAPAPGLPGPPGCAFGSRAPLRGGSTARDGTVRQPGRALPPLGELVWAAASGDDPFHSRGAVVSLVPRPPPVFRRSVSSGPCSPSPQRSVVVAADEFRFRLLPPLAGGESGESAQFARRLGASLSSHFVVAAARGPGLPLTPLLGDGAAQGRLHPPPLPLTRVPHSMAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 821674 - protein, 594 aa, Homo sapiens
MSCPQRGLAPGGSRREPGLPGAPAPAPGLPGPPGCAFGSRAPLRGGSTARDGTVRQPGRALPPLGELVWAAASGDDPFHSRGAVVSLVPRPPPVFRRSVSSGPCSPSPQRSVVVAADEFRFRLLPPLAGGESGESAQFARRLGASLSSHFVVAAARGPGLPLTPLLGDGAAQGRLHPPPLPLTRVPHSMAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 821675 - protein, 594 aa, Homo sapiens; identical to SEQ ID NO: 821674

SEQ ID NO: 821676 - protein, 584 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 821677 - protein, 594 aa, Homo sapiens; identical to SEQ ID NO: 821674

SEQ ID NO: 821678 - protein, 572 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVGECGRGVGEGWQKGRYSTLQCIPLPSLIAL

SEQ ID NO: 821679 - protein, 87 aa, Homo sapiens
VGAAMPDSGPLPLLQDMNKLSGGGGRRTRVEGGQLGGEEWTRHGSFVNKPTRGWLHPNDKVMGPGVSYLVRVSEHPPLHSPADPLQF

SEQ ID NO: 821680 - protein, 584 aa, Homo sapiens; identical to SEQ ID NO: 821676

SEQ ID NO: 821681 - protein, 395 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCYVLEEGQPCQTQAPYPSPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 821682 - protein, 584 aa, Homo sapiens; identical to SEQ ID NO: 821676

SEQ ID NO: 821683 - protein, 594 aa, Homo sapiens; identical to SEQ ID NO: 821674

SEQ ID NO: 821684 - protein, 584 aa, Homo sapiens; identical to SEQ ID NO: 821676

SEQ ID NO: 821685 - protein, 584 aa, Homo sapiens; identical to SEQ ID NO: 821676

SEQ ID NO: 821686 - protein, 596 aa, Homo sapiens
MGMSCPQRGLAPGGSRREPGLPGAPAPAPGLPGPPGCAFGSRAPLRGGSTARDGTVRQPGRALPPLGELVWAAASGDDPFHSRGAVVSLVPRPPPVFRRSVSSGPCSPSPQRSVVVAADEFRFRLLPPLAGGESGESAQFARRLGASLSSHFVVAAARGPGLPLTPLLGDGAAQGRLHPPPLPLTRVPHSMAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 821687 - protein, 584 aa, Homo sapiens; identical to SEQ ID NO: 821676

SEQ ID NO: 821688 - protein, 423 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLACRTASSGRSRSARYSAAALSNTIFLVTA

SEQ ID NO: 821689 - protein, 811 aa, Homo sapiens
RETEVLALLRSPENRASPCWAAGPGQSLGALPRSGAMKRSGTLRLLSDLSAFGGAARLRELVAGDSAVRVRGSPDGRHLLLLRPPGAVAPQLLVASRGPGAELERAWPAGQPSPLDAFFLPWPARPALVLVWESGLAEVWGAGVGPGWRPLQSTELCPGGGARVVAVAALRGRLVWCEERQARAEGPSGSPAAAFSHCVCVRTLEPSGEASTSLGRTHVLLHHCPAFGLLASCRQLFLVPTATTWPGVAHVLLIWSPGKGKVMVAAPRLGLSYSKSLNPGRGDTWDFRTLLRGLPGLLSPREPLAVHTWAPTPQGLLLLDFGGTVSLLQSHGGTRAVGTLQEAPVGPWGSAALGTFQGTLACVLGSTLELLDMGSGQLLERKVLSTDRVHLLEPPAPGMEDEEELETRGNLRLLSALGLFCVGWEAPQGVELPSAKDLVFEEACGYYQRRSLRGAQLTPEELRHSSTFRAPQALASILQGHLPPSALLTMLRTELRDYRGLEQLKAQLVAGDDEEAGWTELAEQEVARLLRTELIGDQLAQLNTVFQALPTAAWGATLRALQLQLDGNGKLRSQAPPDVWKKVLGGITAGKEPPNGILPPFELLCQCLCQLEPRWLPPFVELAQQQGGPGWGAGGPGLPLYRRALAVLGEEGTRPEALELELLLSSGRPKAVLQAVGQLVQKEQWDRALDAGLALGPSSPLLRSEIFKLLLAEFAQHRRLDAHLPLLCRLCPPELAPAELLLLLRTYLPDEVGPPTPFPEPGAEPPLTVGLLKALLEQTGAQGWLSGPVLSPYEDILWDPSTPPPTPPRDL

SEQ ID NO: 821690 - protein, 759 aa, Homo sapiens
RETEVLALLRSPENRASPCWAAGPGQSLGALPRSGAMKRSGTLRLLSDLSAFGGAARLRELVAGDSAVRVRGSPDGRHLLLLRPPGAVAPQLLVASRGPGAELERAWPAGQPSPLDAFFLPWPARPALVLVWESGLAEVWGAGVGPGWRPLQSTELCPGGGARVVAVAALRGRLVWCEERQARAEGPSGSPAAAFSHCVCVRTLEPKGKVMVAAPRLGLSYSKSLNPGRGDTWDFRTLLRGLPGLLSPREPLAVHTWAPTPQGLLLLDFGGTVSLLQSHGGTRAVGTLQEAPVGPWGSAALGTFQGTLACVLGSTLELLDMGSGQLLERKVLSTDRVHLLEPPAPGMEDEEELETRGNLRLLSALGLFCVGWEAPQGVELPSAKDLVFEEACGYYQRRSLRGAQLTPEELRHSSTFRAPQALASILQGHLPPSALLTMLRTELRDYRGLEQLKAQLVAGDDEEAGWTELAEQEVARLLRTELIGDQLAQLNTVFQALPTAAWGATLRALQLQLDGNGKLRSQAPPDVWKKVLGGITAGKEPPNGILPPFELLCQCLCQLEPRWLPPFVELAQQQGGPGWGAGGPGLPLYRRALAVLGEEGTRPEALELELLLSSGRPKAVLQAVGQLVQKEQWDRALDAGLALGPSSPLLRSEIFKLLLAEFAQHRRLDAHLPLLCRLCPPELAPAELLLLLRTYLPDEVGPPTPFPEPGAEPPLTVGLLKALLEQTGAQGWLSGPVLSPYEDILWDPSTPPPTPPRDL

SEQ ID NO: 821691 - protein, 793 aa, Homo sapiens
RETEVLALLRSPENRASPCWAAGPGQSLGALPRSGAMKRSGTLRLLSDLSAFGGAARLRELVAGDSAVRVRGSPDGRHLLLLRPPGAVAPQLLVASRGPGAELERAWPAGQPSPLDAFFLPWPARPALVLVWESGLAEVWGAGVGPGWRPLQSTELCPGGGARVVAVAALRGRLVWCEERQARAEGPSGSPAAAFSHCVCVRTLEPSGEASTSLGRTHVLLHHCPAFGLLASCRQLFLVPTATTWPGVAHVLLIWSPGKGKVMVAAPRLGLSYSKSLNPGRGDTWDFRTLLRGLPGLLSPREPLAVHTWAPTPQGLLLLDFGGTVSLLQSHGGTRAVGTLQEAPVGPWGSAALGTFQGTLACVLGSTLELLDMGSGQLLERKVLSTDRVHLLEPPAPGMEDEEELETRGNLRLLSALGLFCVGWEAPQGVELPSAKDLVFEEACGYYQRRSLRGAQLTPEELRHSSTFRAPQALASILQGHLPPSALLTMLRTELRDYRGLEQLKAQLVAGDDEEAGWTELAEQEVARLLRTELIGDQLAQLNTVFQALPTAAWGATLRALQLQLDGNGKLRSQAPPDVWKKVLGGITAGKEPPNGILPPFELLCQCLCQLEPRWLPPFVELAQQQGGPGWGAGGPGLPLYRRALAVLGEEGTRPEALELELLLSSGRPKAVLQAVGQLVHPLLRSEIFKLLLAEFAQHRRLDAHLPLLCRLCPPELAPAELLLLLRTYLPDEVGPPTPFPEPGAEPPLTVGLLKALLEQTGAQGWLSGPVLSPYEDILWDPSTPPPTPPRDL

SEQ ID NO: 821692 - protein, 811 aa, Homo sapiens; identical to SEQ ID NO: 821689

SEQ ID NO: 821693 - protein, 720 aa, Homo sapiens
RETEVLALLRSPENRASPCWAAGPGQSLGALPRSGAMKRSGTLRLLSDLSAFGGAARLRELVAGDSAVRVRGSPDGRHLLLLRPPGAVAPQLLVASRGPGAELERAWPAGQPSPLDAFFLPWPARPALVLVWESGLAEVWGAGVGPGWRPLQSTELCPGGGARVVAVAALRGRLVWCEERQARAEGPSGSPAAAFSHCVCVRTLEPSGEASTSLGRTHVLLHHCPAFGLLASCRQLFLVPTATTWPGVAHVLLIWSPGKGKVMVAAPRLGLSYSKSLNPGRGDTWDFRTLLRGLPGLLSPREPLAVHTWAPTPQGLLLLDFGGTVSLLQSHGGTRAVGTLQEAPVGPWGSAALGTFQGTLACVLGSTLELLDMGSGQLLERKVLSTDRVHLLEPPAPGMEDEEELETRGNLRLLSALGLFCVGWEAPQGVELPSAKDLVFEEACGYYQRRSLRGAQLTPEELRHSSTFRAPQALASILQGHLPPSALLTMLRTELRDYRGLEQLKAQLVAGDDEEAGWTELAEQEVARLLRTELIGDQLAQLNTVFQALPTAAWGATLRALQLQLDGNGKLRSQAPPDVWKKVLGGITAGKEPPNGILPPFELLCQCLCQLEPRWLPPFVELAQQQGGPGWGAGGPGLPLYRRALAVLGEEGTRPEALELELLLSSGRPKAVLQAVGQLVQKEQWDRALDAGLALGPSSPLLRSEIFKLLLAEFAQHRLA

SEQ ID NO: 821694 - protein, 1712 aa, Homo sapiens
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVRTTFSRCLSKEWGSFLEESYPYFLIVADEGLNDLQTQLFNFLIIHSWARKVNVVLSSGQESDVLCLYAYLLPSMYRHQIFSWKNKQNIKDAYTTLLNQLERFKLSALAPLFGSLKWNNITEEAHKTVSLLTQVWPEGSDIRRVFCVTSCSLSLRMYHRFLGNREPSSGQETEIQQVNSNCLTLQEMEDLCKLHCLTVVFLLHLPLSQRACARVITSHWAEDMKPLLQMKKWCEYFILRNIHTFEFWNLNLIHLSDLNDELLLKNIAFYYENENVKGLHLNLGDTIMKDYEYLWNTVSKLVRDFEVGQPFPLRTTKVCFLEKKPSPIKDSSNEMVPNLGFIPTSSFVVDKFAGDILKDLPFLKSDDPIVTSLVKQKEFDELVHWHSHKPLSDDYDRSRCQFDEKSRDPRVLRSVQKYHVFQRFYGNSLETVSSKIIVTQTIKSKKDFSGPKSKKAHETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKKTRNVDQSLIHEAEHDNLVKCLEKNLEIPQDCTYADQKAVDTETLQKVFGRVKFERKGEELKALAERGIGYHHSAMSFKEKQLVEILFRKGYLRVVTATGTLALGVNMPCKSVVFAQNSVYLDALNYRQMSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSISVSLRELCENEDDNVVLAFEQLSTTFWEKLNKV

SEQ ID NO: 821695 - protein, 1698 aa, Homo sapiens
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVRTTFSRCLSKEWGSFLEESYPYFLIVADEGLNDLQTQLFNFLIIHSWARKVNVVLSSGQESDVLCLYAYLLPSMYRHQIFSWKNKQNIKDAYTTLLNQLERFKLSALAPLFGSLKWNNITEEAHKTVSLLTQVWPEGSDIRRVFCVTSCSLSLRMYHRFLGNREPSSGQETEIQQVNSNCLTLQEMEDLCKLHCLTVVFLLHLPLSQRACARVITSHWAEDMKPLLQMKKWCEYFILRNIHTFEFWNLNLIHLSDLNDELLLKNIAFYYENENVKGLHLNLGDTIMKDYEYLWNTVSKLVRDFEVGQPFPLRTTKVCFLEKKPSPIKDSSNEMVPNLGFIPTSSFVVDKFAGDILKDLPFLKSDDPIVTSLVKQKEFDELVHWHSHKPLSDDYDRSRCQFDEKSRDPRVLRSVQKYHVFQRFYGNSLETVSSKIIVTQTIKSKKDFSGPKSKKAHETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKKTRNVDQSLIHEAEHDNLVKCLEKNLEIPQDCTYADQKAVDTETLQKVFGRVKFERKGEELKALAERGIGYHHSAMSFKEKQLVEILFRKGYLRVVTATGTLALGVNMPCKSVVFAQNSVYLDALNYRQMSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSIRCVIYLNIDFRFFNNLFII

SEQ ID NO: 821696 - protein, 1145 aa, Homo sapiens
MFFPLGQETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKKTRNVDQSLIHEAEHDNLVKCLEKNLEIPQDCTYADQKAVDTETLQKVFGRVKFERKGEELKALAERGIGYHHSAMSFKEKQLVEILFRKGYLRVVTATGTLALGVNMPCKSVVFAQNSVYLDALNYRQMSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSISVSLRELCENEDDNVVLAFEQLSTTFWEKLNKV

SEQ ID NO: 821697 - protein, 1700 aa, Homo sapiens
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVRTTFSRCLSKEWGSFLEESYPYFLIVADEGLNDLQTQLFNFLIIHSWARKVNVVLSSGQESDVLCLYAYLLPSMYRHQIFSWKNKQNIKDAYTTLLNQLERFKLSALAPLFGSLKWNNITEEAHKTVSLLTQVWPEGSDIRRVFCVTSCSLSLRMYHRFLGNREPSSGQETEIQQVNSNCLTLQEMEDLCKLHCLTVVFLLHLPLSQRACARVITSHWAEDMKPLLQMKKWCEYFILRNIHTFEFWNLNLIHLSDLNDELLLKNIAFYYENENVKGLHLNLGDTIMKDYEYLWNTVSKLVRDFEVGQPFPLRTTKVCFLEKKPSPIKDSSNEMVPNLGFIPTSSFVVDKFAGDILKDLPFLKSDDPIVTSLVKQKEFDELVHWHSHKPLSDDYDRSRCQFDEKSRDPRVLRSVQKYHVFQRFYGNSLETVSSKIIVTQTIKSKKDFSGPKSKKAHETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKKTRNVDQSLIHEAEHDNLVKCLEKNLEIPQDCTYADQKAVDTETLQKVFGRVKFERKGEELKALAERGIGYHHSAMSFKEKQLVEILFRKGYLRVVTATGTLALGVNMPCKSVVFAQNSVYLDALNYRQMSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHAPVLLSQKFDNRGRKMSLNAYALDFYKHGSLIGLVQDNRMNEGDAYYLLKDFALTIKSISVSLRELCENEDDNVVLAFEQLSTTFWEKLNKV

SEQ ID NO: 821698 - protein, 1336 aa, Homo sapiens
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVRTTFSRCLSKEWGSFLEESYPYFLIVADEGLNDLQTQLFNFLIIHSWARKVNVVLSSGQESDVLCLYAYLLPSMYRHQIFSWKNKQNIKDAYTTLLNQLERFKLSALAPLFGSLKWNNITEEAHKTVSLLTQVWPEGSDIRRVFCVTSCSLSLRMYHRFLGNREPSSGQETEIQQVNSNCLTLQEMEDLCKLHCLTVVFLLHLPLSQRACARVITSHWAEDMKPLLQMKKWCEYFILRNIHTFEFWNLNLIHLSDLNDELLLKNIAFYYENENVKGLHLNLGDTIMKDYEYLWNTVSKLVRDFEVGQPFPLRTTKVCFLEKKPSPIKDSSNEMVPNLGFIPTSSFVVDKFAGDILKDLPFLKSDDPIVTSLVKQKEFDELVHWHSHKPLSDDYDRSRCQFDEKSRDPRVLRSVQKYHVFQRFYGNSLETVSSKIIVTQTIKSKKDFSGPKSKKAHETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTDQQCLTHPAQHMVTGTHQAQHTTSISTHHITLLLKQHHDKSQIKAQAYFPEQHSTLPQFNTPTSVITSSSTYVSFHNLRTPRKRTSHRIHQASTQTIDTLLNTHLSQHNRGRTAAIKLLMDFKIITSDQMIRLGERYQHKQDFNTIVKHRGTGDIFTIALDIIYHTCYNPIPHSNRDENHKSVGYLGTAPMDPPKPLRGAHHTRGGTIQSTPHRRQPLGLKPPANNQQDHVQTSVENDNIHTHEEYTLTTQRASRKRLRDHTQMPNDRQAPTTAGPGTIHTARLEVHCTINVGNNRHPHTRGPRARGTKSEKHSRRARGQAHSQSEAHEQQRLPHAQVEPATHRAAQLKHTCERSTTAQTTRTITEEEPDTNKPRRSNRCTNTARQTAERQHRRRPSNRKTGNSKQNR

SEQ ID NO: 821699 - protein, 283 aa, Homo sapiens
QGRPLRRRTSDGRRERFLLPAAALAMAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKRILEDQEENPLPAALVQPHTGKLCWFLDEAAARLLTVPFEKHSTL

SEQ ID NO: 821700 - protein, 283 aa, Homo sapiens; identical to SEQ ID NO: 821699

SEQ ID NO: 821701 - protein, 174 aa, Homo sapiens
LISQMEKLRPEETHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKRILEDQEENPLPAALVQPHTGKLCWFLDEAAARLLTVPFEKHSTL

SEQ ID NO: 821702 - protein, 222 aa, Homo sapiens
ITFPDAFKAIIPKVSQMNRICYINQCAFQMTYYSGDRPQSPQAYPGTDPLEEGHGAGLYRTHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKRILEDQEENPLPAALVQPHTGKLCWFLDEAAARLLTVPFEKHSTL

SEQ ID NO: 821703 - protein, 318 aa, Homo sapiens
QGRPLRRRTSDGRRERFLLPAAALAMAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQELPQGSLADPFEESPLRGHSPALGSLKATLASVAQAFQGDSIPVFDLLILGVGPDGHTCSLFPDHPLLQEREKIVAPISDSPKPPPQRVTLTLPVLNAARTVIFVATGEGKAAVLKRILEDQEENPLPAALVQPHTGKLCWFLDEAAARLLTVPFEKHSTL

SEQ ID NO: 821704 - protein, 279 aa, Homo sapiens
QGRPLRRRTSDGRRERFLLPAAALAMAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKVTAEGSSPGKFMGMWAPGTENGPRHYCAEASDLKKTQSFLG

SEQ ID NO: 821705 - protein, 64 aa, Homo sapiens
MVTPATLYEVVEVNGVCVEGKQHGDVVSAIRAGGDETKLLVVDRETDEFFKKCRVIPSHEHLNV

SEQ ID NO: 821706 - protein, 233 aa, Homo sapiens
QGRPLRRRTSDGRRERFLLPAAALAMAAPAPGLISVFSSSQELGAALAQLVAQRAACCLAGARARFALGLSGGSLVSMLARELPAAVAPAGPASLARWTLGFCDERLVPFDHAESTYGLYRVRATGAAGDHAERATATAYTPATEAAGGHAERAAPTVCTSATGATGYHAKRAVPTACTSATWVAGGHAKRAGPPVALGYGGHWGSCRDGHAHCLHLDYGGRWGSSRQGSPAS

SEQ ID NO: 821707 - protein, 182 aa, Homo sapiens
NCSSSNPVAFLLCLLVEGYLHSKCVNGVGPSGACPQEVCEETGTVARADAARDKYTATPLLLDSVLPPRGHGWVYGEADYPPHTESSGGRPAKGQSARPQAQAQGQVREPRPQDMLPFCQERLFWGPGWDWAPETKTPCLTQPGPSWSLLGVLWLGTRQAPVPCQAWCPPGPPARASLPPAS

SEQ ID NO: 821708 - protein, 784 aa, Homo sapiens
GGRRRHVVRCRGSGVSVLLRCVESWGGYMGQACSGLLSPWYRSLGGLARSPPAFQLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 821709 - protein, 812 aa, Homo sapiens
GGRRRHVVRCRGSGVSVLLRCVESWGGYMGQACSGLLSPWYRSLGGLARSPPAFQLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEVGTGRGLRPGPPAWPPSGTSLLGGGFSQITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 821710 - protein, 775 aa, Homo sapiens
GGRRRHVVRCRGSGVSVLLRCVESWGGYMGQACSGLLSPWYRSLGGLARSPPAFQLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEGLRPRPKAK

SEQ ID NO: 821711 - protein, 803 aa, Homo sapiens
GGRRRHVVRCRGSGVSVLLRCVESWGGYMGQACSGLLSPWYRSLGGLARSPPAFQLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEGNSGRGPGHRPTPGRWHPAGPSPSPLGTASSSGTQER

SEQ ID NO: 821712 - protein, 822 aa, Homo sapiens
GGRRRHVVRCRGSGVSVLLRCVESWGGYMGQACSGLLSPWYRSLGGLARSPPAFQLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPGPALSAEAAVQPAGLQRDEARPTDQMPLGSEGARGGRKVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 821713 - protein, 437 aa, Homo sapiens
MQAAPGTWSSPRKARQGLINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 821714 - protein, 113 aa, Homo sapiens
GGRRRHVVRCRGSGVSVLLRCVESWGGYMGQACSGLLSPWYRSLGGLARSPPAFQLAALHLQPPRGGRHGGGHRGPGGPWLGLSMGPQPSAGEPTHTAHEEAELAEAAIQRGT

SEQ ID NO: 821715 - protein, 1264 aa, Homo sapiens
WNTETPTECSESPPPPTLYVQLHGETTRRLEAEEKPLQIQNDYLFQLGFGELWRVQEEGMDSEIGCLIRFYAGKPHSTGSSERIQLSGMYNVRKGKMQLPVNRWTRRQVILCGTCLIVSSVKDSLTGKMHVLPLIGGKVEEVKKHQHCLAFSSSGPQSQTYYICFDTFTEYLRWLRQVSKVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 821716 - protein, 1116 aa, Homo sapiens
MPTGNLTWIRMIVTSSFSFQFPPSIVICSSSYVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 821717 - protein, 1264 aa, Homo sapiens; identical to SEQ ID NO: 821715

SEQ ID NO: 821718 - protein, 611 aa, Homo sapiens
MIFLTSALIELNKVAFLNNSLPDCMSSTYLQSCAYLLDWKTLAVLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 821719 - protein, 779 aa, Homo sapiens
WNTETPTECSESPPPPTLYVQLHGETTRRLEAEEKPLQIQNDYLFQLGFGELWRVQEEGMDSEIGCLIRFYAGKPHSTGSSERIQLSGMYNVRKGKMQLPVNRWTRRQVILCGTCLIVSSVKDSLTGKMHVLPLIGGKVEEVKKHQHCLAFSSSGPQSQTYYICFDTFTEYLRWLRQVSKVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKKIEGPHPLSEEKTYGDKPRKAPERGGLTGDTERGGGALTFSPVGP

SEQ ID NO: 821720 - protein, 791 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821721 - protein, 903 aa, Homo sapiens
MNGSWTWFFWIIAMPSLGVPTQMPVVPAPPACSLSLPGGSTKVPCESDVPIDVETVTSTPMPLYDNQKARSVMNECERHVIFARTDADAPPPPEDWEEHVNRVSLCHPDCSAVARSRLTTSLDLQELSLLVDHHPSVMTLPHCHRLMLTHHLFWTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821722 - protein, 766 aa, Homo sapiens
MTLPHCHRLMLTHHLFWTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821723 - protein, 753 aa, Homo sapiens
MNGSWTWFFWIIAMPSLGVPTQMPVVPAPPACSLSLPGGSTKVPCESDVPIDVETVTSTPMPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQAQFAAFLKQNMLVRKALPPGTSSCLFVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQA

SEQ ID NO: 821724 - protein, 791 aa, Homo sapiens; identical to SEQ ID NO: 821720

SEQ ID NO: 821725 - protein, 742 aa, Homo sapiens
RGGVNAHALRDPAVAERAAVRPRACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821726 - protein, 729 aa, Homo sapiens
MFYYFHLHPSACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821727 - protein, 833 aa, Homo sapiens
MPLYDNQKARSVMNECERHVIFARTDADAPPPPEDWEEHVNRTGWTMAQNKLFNKILKALQSDRLARLANEGVRHQQSAHSGLFVVQASLADRLVPLLVNQVVLMFYYFHLHPSACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821728 - protein, 791 aa, Homo sapiens; identical to SEQ ID NO: 821720

SEQ ID NO: 821729 - protein, 672 aa, Homo sapiens
MLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821730 - protein, 650 aa, Homo sapiens
MLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821731 - protein, 265 aa, Homo sapiens
LVEPGSNRTRLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821732 - protein, 229 aa, Homo sapiens
TVGRPTRRASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 821733 - protein, 791 aa, Homo sapiens; identical to SEQ ID NO: 821720

SEQ ID NO: 821734 - protein, 791 aa, Homo sapiens; identical to SEQ ID NO: 821720

SEQ ID NO: 821735 - protein, 805 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQVSLPGRTEDMGFIIGKFKTS

SEQ ID NO: 821736 - protein, 805 aa, Homo sapiens; identical to SEQ ID NO: 821735

SEQ ID NO: 821737 - protein, 530 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPVYSWFHH

SEQ ID NO: 821738 - protein, 484 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSSLRKLYFLERERKLYLFHRRPGIHNLRRQYY

SEQ ID NO: 821739 - protein, 794 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQGKYCTEVNT

SEQ ID NO: 821740 - protein, 788 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQQHG

SEQ ID NO: 821741 - protein, 788 aa, Homo sapiens; identical to SEQ ID NO: 821740

SEQ ID NO: 821742 - protein, 661 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGILWPSILPFQHRIFGLLLLGGPGKASLELNP

SEQ ID NO: 821743 - protein, 495 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRKPKADNCSDILHY

SEQ ID NO: 821744 - protein, 385 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRWVDSPRAARELCYSVRDKPGSWQCNYRPVWFS

SEQ ID NO: 821745 - protein, 137 aa, Homo sapiens
MNGSWTWFFWIIAMPSLGVPTQMPVVPAPPACSLSLPGGSTKVPCESDVPIDVETVTSTPMPLYDNQKARSVMNECERHVIFARTDADAPPPPEDWEEHVNRVSLCHPDCSAVARSRLTTSLDLQDSVSLWTTTLLL

SEQ ID NO: 821746 - protein, 111 aa, Homo sapiens
ALASRGVAGRGDRGRGWDGRGSRRGLQGSRGMRGPGLGPAAGAGRAGRVGPGAGWQGPRLGLRDADAEPCPREREAGGGGQAAPPRRELWMTLAKSLQFPELATSSVKCES

SEQ ID NO: 821747 - protein, 484 aa, Homo sapiens
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 821748 - protein, 136 aa, Homo sapiens
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGMKLLIL

SEQ ID NO: 821749 - protein, 107 aa, Homo sapiens
GRLLLLLLLLIRRRVEILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 821750 - protein, 178 aa, Homo sapiens
IECFRDESRRSSCQLHFVVGARRSQLRDSRDCVTSFVSFDLESLSRTMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGV

SEQ ID NO: 821751 - protein, 178 aa, Homo sapiens; identical to SEQ ID NO: 821750

SEQ ID NO: 821752 - protein, 106 aa, Homo sapiens
MTRIGIMENGGAAAVIKEGRDHIAVPRRTSAANTITLKCVIDHSRRYIDEYRNDYTQGCEPGHRQRDHESRYQNHSSKSSGRSGRSSYKSKHRIHHSTSHRRSHGV

SEQ ID NO: 821753 - protein, 183 aa, Homo sapiens
CCEPPRRSCKMAAGRRPASALWPERRGSPLRGDLLGFQNVREPSSCGETLSGMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGV

SEQ ID NO: 821754 - protein, 131 aa, Homo sapiens
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGV

SEQ ID NO: 821755 - protein, 225 aa, Homo sapiens
IECFRDESRRSSCQLHFVVGARRSQLRDSRDCVTSFVSFDLESLSRTMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARCIEYFSTLINFSDNIIYI

SEQ ID NO: 821756 - protein, 178 aa, Homo sapiens; identical to SEQ ID NO: 821750

SEQ ID NO: 821757 - protein, 531 aa, Homo sapiens
IECFRDESRRSSCQLHFVVGARRSQLRDSRDCVTSFVSFDLESLSRTMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 821758 - protein, 183 aa, Homo sapiens
IECFRDESRRSSCQLHFVVGARRSQLRDSRDCVTSFVSFDLESLSRTMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGMKLLIL

SEQ ID NO: 821759 - protein, 346 aa, Homo sapiens
MSTEMTTLKDVNLDIAKETMKADEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 821760 - protein, 178 aa, Homo sapiens; identical to SEQ ID NO: 821750

SEQ ID NO: 821761 - protein, 178 aa, Homo sapiens; identical to SEQ ID NO: 821750

SEQ ID NO: 821762 - protein, 307 aa, Homo sapiens
MHLSNRGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 821763 - protein, 258 aa, Homo sapiens
MLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 821764 - protein, 178 aa, Homo sapiens; identical to SEQ ID NO: 821750

SEQ ID NO: 821765 - protein, 178 aa, Homo sapiens; identical to SEQ ID NO: 821750

SEQ ID NO: 821766 - protein, 178 aa, Homo sapiens; identical to SEQ ID NO: 821750

SEQ ID NO: 821767 - protein, 178 aa, Homo sapiens; identical to SEQ ID NO: 821750

SEQ ID NO: 821768 - protein, 178 aa, Homo sapiens; identical to SEQ ID NO: 821750

SEQ ID NO: 821769 - protein, 86 aa, Homo sapiens
AGPPVTTARKRKYFHHDRLDWDEHSSAGRYVSRRCKPLKEFMLSQDVEHERLFDLIQKMLEYDPAKRITLREALKHPFFDLLKKSI

SEQ ID NO: 821770 - protein, 178 aa, Homo sapiens; identical to SEQ ID NO: 821750

SEQ ID NO: 821771 - protein, 624 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 821772 - protein, 598 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 821773 - protein, 370 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQK

SEQ ID NO: 821774 - protein, 598 aa, Homo sapiens; identical to SEQ ID NO: 821772

SEQ ID NO: 821775 - protein, 598 aa, Homo sapiens; identical to SEQ ID NO: 821772

SEQ ID NO: 821776 - protein, 624 aa, Homo sapiens; identical to SEQ ID NO: 821771

SEQ ID NO: 821777 - protein, 558 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTL

SEQ ID NO: 821778 - protein, 598 aa, Homo sapiens; identical to SEQ ID NO: 821772

SEQ ID NO: 821779 - protein, 598 aa, Homo sapiens; identical to SEQ ID NO: 821772

SEQ ID NO: 821780 - protein, 644 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREFMIVRLYAKHYKYSTLQLTMGLRSDKPVIYGKYPQRMKQETES

SEQ ID NO: 821781 - protein, 524 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVDSLAGCEPASRIVCNFPVGHDSAPLITRCVVQNKCAVCFGGLE

SEQ ID NO: 821782 - protein, 228 aa, Homo sapiens
VKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKIKHHCIEGLVAGKKQRNPGKVGKIAGEG

SEQ ID NO: 821783 - protein, 1222 aa, Homo sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHTTLIFNPTRKLPEQDIAQGSYIALPLTLLVLLAGYNHDKLIPLLLQLTSRLQGVRALGQAASDNSGPEDAKRQAKKQKTRRT

SEQ ID NO: 821784 - protein, 662 aa, Homo sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPEAVSFDIPTSNARGFRFLHLLRQHLLLSVLL

SEQ ID NO: 821785 - protein, 677 aa, Homo sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKKKKKNTLSGRGSGGRRKKGFLKTNSRLGGAVGRPHGRFTRRPVGQNTRLSPRERTRGGKRHTRVGGVSLPKIKKKPGAVGDTRSGVSWNRTTQEEEVRGGATFTRELLLQAGEVPEERHDN

SEQ ID NO: 821786 - protein, 1281 aa, Homo sapiens
MLVGQGAGPLGPAVVTAAVVLLLSGVGPAHGSEDIVVGCGGFVKSDVEINYSLIEQVLNMIDVNLYNHMKRSGSVSTSEETEHELAQGHATRGRLRWHLGILLGYHFVSGNAQNIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHTTLIFNPTRKLPEQDIAQGSYIALPLTLLVLLAGYNHDKLIPLLLQLTSRLQGVRALGQAASDNSGPEDAKRQAKKQKTRRT

SEQ ID NO: 821787 - protein, 183 aa, Homo sapiens
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 821788 - protein, 221 aa, Homo sapiens
IATWSCIWQGQGGSSERSHKRNFSAVLSDTTPACLFVAMRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 821789 - protein, 183 aa, Homo sapiens; identical to SEQ ID NO: 821787

SEQ ID NO: 821790 - protein, 147 aa, Homo sapiens
IATWSCIWQGQGGSSERSHKRNFSAVLSDTTPACLFVAMRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLGKGFLDSWKNGGTP

SEQ ID NO: 821791 - protein, 40 aa, Homo sapiens
MTWTFDPRYRYSSSRYTKCGSRLDKSNTMISRETHRHIED

SEQ ID NO: 821792 - protein, 206 aa, Homo sapiens
FKRGGVTRTAVLSDTTPACLFVAMRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 821793 - protein, 217 aa, Homo sapiens
MRAAYLFLLFLPAGLLAQGQYDLDPLPPFPDHVQYTHYSDQIDNPDYYDYQGNGLGVGEDGPAAGVGRPPGRGRGSRPPYPPLAAEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 821794 - protein, 153 aa, Homo sapiens
MRAAYLFLLFLPDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 821795 - protein, 169 aa, Homo sapiens
PELSSVGEEGAGLREAAGLAGEAEGKPRQESVLEAGRRQREIEAYFLAEGPRVSHFGRLDFLLCEMGNTPTLAHLTPLTPSTSSESSCEEEEALHRREDGPGRLYPGDTPPPRRWNPEGTAWRPMRAARVRTQRLRGWRAGASPVGGPEGDSERAKGRLRRADSERAAE

SEQ ID NO: 821796 - protein, 183 aa, Homo sapiens; identical to SEQ ID NO: 821787

SEQ ID NO: 821797 - protein, 183 aa, Homo sapiens; identical to SEQ ID NO: 821787

SEQ ID NO: 821798 - protein, 206 aa, Homo sapiens; identical to SEQ ID NO: 821792

SEQ ID NO: 821799 - protein, 415 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHR

SEQ ID NO: 821800 - protein, 786 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPAAETTGEVCLKYTLQGKTFEDKVTFPLQPKPDVNLTIHRLAAKSLLQTKDMGLRETPASDKKDALNLSLESGVISSFTAFIAINKELNKPVQGPLAHRDVPRPILLGASAPLKIKCQSGFRKALHSDRPPSASQPRGELMCYKAKTFQMDDYSLCGLISHKDQHSPGFGENHLVQLIYHQNANGSWDLNEDLAKILGMSLEEIMAAQPAELVDSSGWATILAVIWLHSNGKDLKCEWELLERKAVAWMRAHAGSTMPSVVKAAITFLKSSVDPAIFAF

SEQ ID NO: 821801 - protein, 856 aa, Homo sapiens
AVLSGNYDCSCFHSAVTQSAPGCRRGSPACSTRELAQVRGLRRSPFLSILSSPHTCHCPLRCCRIKSCITMVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPAAETTGEVCLKYTLQGKTFEDKVTFPLQPKPDVNLTIHRLAAKSLLQTKDMGLRETPASDKKDALNLSLESGVISSFTAFIAINKELNKPVQGPLAHRDVPRPILLGASAPLKIKCQSGFRKALHSDRPPSASQPRGELMCYKAKTFQMDDYSLCGLISHKDQHSPGFGENHLVQLIYHQNANGSWDLNEDLAKILGMSLEEIMAAQPAELVDSSGWATILAVIWLHSNGKDLKCEWELLERKAVAWMRAHAGSTMPSVVKAAITFLKSSVDPAIFAF

SEQ ID NO: 821802 - protein, 786 aa, Homo sapiens; identical to SEQ ID NO: 821800

SEQ ID NO: 821803 - protein, 263 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGSGCTAMVRT

SEQ ID NO: 821804 - protein, 333 aa, Homo sapiens
AVLSGNYDCSCFHSAVTQSAPGCRRGSPACSTRELAQVRGLRRSPFLSILSSPHTCHCPLRCCRIKSCITMVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGSGCTAMVRT

SEQ ID NO: 821805 - protein, 549 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPPAETTGEVSRNTKGERKSKCQGPETRRDGRGLLCSKRIHGS

SEQ ID NO: 821806 - protein, 1346 aa, Homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHMGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSTVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 821807 - protein, 1173 aa, Homo sapiens
MRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHMGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSTVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 821808 - protein, 1369 aa, Homo sapiens
IIPALWEAEMGGSLEANQLKLEDMKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHMGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSTVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 821809 - protein, 1346 aa, Homo sapiens; identical to SEQ ID NO: 821806

SEQ ID NO: 821810 - protein, 1346 aa, Homo sapiens; identical to SEQ ID NO: 821806

SEQ ID NO: 821811 - protein, 719 aa, Homo sapiens
SSDYRSQVHVESREGLWKIKGKIKKLGSSEKVTESKGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSTVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 821812 - protein, 1346 aa, Homo sapiens; identical to SEQ ID NO: 821806

SEQ ID NO: 821813 - protein, 1363 aa, Homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHMGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSTVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLEARAEFGRSIPASTGAAKAVGKVIPELNGKLTGMAFRVPTANVSVVDLTCRLEKPAKYAIKKVVKQA

SEQ ID NO: 821814 - protein, 151 aa, Homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTDKLLGPLPCVLLPWYINGHNKDWFKILRWDDFKRLHHLKNLG

SEQ ID NO: 821815 - protein, 233 aa, Homo sapiens
RTLCLFLTPAERKCSRLCEAESSFKYESGLFVQGLLKDSTGSFVLPFRQVMYAPYPTTHIDVDVNTVKQMPPCHEHIYNQRRYMRSELTAFWRATSEEDMAQDTIIYTDESFTPDLNIFQDVLHRDTLVKAFLDQVFQLKPGLSLRSTFLAQFLLVLHRKALTLIKYIEDDTQKGKKPFKSLRNLKIDLDLTAEGDLNIIMALAEKIKPGLHSFIFGRPFYTSVQERDVLMTF

SEQ ID NO: 821816 - protein, 233 aa, Homo sapiens; identical to SEQ ID NO: 821815

SEQ ID NO: 821817 - protein, 548 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 821818 - protein, 622 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPRSIECLLCLLSLLTQLPLPLPKPGRQDPSPRRRWPEP

SEQ ID NO: 821819 - protein, 639 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 821820 - protein, 80 aa, Homo sapiens
MATGANATPLDFPSKKRKRSRWNQDTMEQKTVIPGMPTVIPPGLTREQERAYIGKYTFCIQMHFEIVTIYSEQDLHFLKV

SEQ ID NO: 821821 - protein, 206 aa, Homo sapiens
MEQKTVIPGMPTVIPPGLTREQERAYIAVKLREQEQKGGQKLRLQQQEERRRLAGGRELRRVEEDKERALGLQREKMRELRERMLSILLSKKPDTANTHDELGVAHADLLQPVLDILQTDVVRLCERDQRLNAPRGPGPRPVAPKGEAGTNPKGPTGHPKKGETGQRGEGGPTRREGQTDRSTSAPRMTPESKGRTDEKQHETRKR

SEQ ID NO: 821822 - protein, 100 aa, Homo sapiens
HPVIQQARAYLLPSVPKPIWQPTAASTFYDHTPQQPDHSSHISLLLKIEEEKQEAEDQNDLRKMQLRELARLNGTLREDDNRIFKTWQKQEARSRKRQKR

SEQ ID NO: 821823 - protein, 639 aa, Homo sapiens; identical to SEQ ID NO: 821819

SEQ ID NO: 821824 - protein, 639 aa, Homo sapiens; identical to SEQ ID NO: 821819

SEQ ID NO: 821825 - protein, 613 aa, Homo sapiens
MEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 821826 - protein, 524 aa, Homo sapiens
MVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 821827 - protein, 524 aa, Homo sapiens; identical to SEQ ID NO: 821826

SEQ ID NO: 821828 - protein, 586 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPRPLLLRLPWTLLTLSP

SEQ ID NO: 821829 - protein, 524 aa, Homo sapiens; identical to SEQ ID NO: 821826

SEQ ID NO: 821830 - protein, 608 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYDPSPRRRWPEP

SEQ ID NO: 821831 - protein, 543 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGLTGTIEPHTSRQVSWDEPLGSAGVVNRKGLSAASTAWFRRHDVCPAPSSSASHGPF

SEQ ID NO: 821832 - protein, 632 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 821833 - protein, 496 aa, Homo sapiens
GTSWWCCCLVVLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 821834 - protein, 302 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVVLLLPPTTHLHRLSCLPPRAAHPG

SEQ ID NO: 821835 - protein, 493 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVQLPTPITQPDRWAWWTSHAAQPQWTPTPLDAATTTTDEPGPPPSWAPWPSSNGSVPGKYACGLWGLSPASRKRYDAATTYGHDAAAAAASQWAAPTPSLWSSSPMATTAAAASATPSAQQQYGFQYPLAMAAKYDDYHHERWHRVHPAMATAAGGCRSFSRSPSDARQPHYGAPAPRGPAASAAWGPSPSAASTAWFRRHDVCPAPSSSASHGPF

SEQ ID NO: 821836 - protein, 298 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVVAGMPPFGMPPAPPPPPPQN

SEQ ID NO: 821837 - protein, 639 aa, Homo sapiens; identical to SEQ ID NO: 821819

SEQ ID NO: 821838 - protein, 639 aa, Homo sapiens; identical to SEQ ID NO: 821819

SEQ ID NO: 821839 - protein, 565 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPQGASMVVLLHGYGNKEQSSSATTVRQKKYGTKLPPAMEERYSPEEARPRQEEGGFPGLGTLTEKVRTPRGQEVGDS

SEQ ID NO: 821840 - protein, 517 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQQKEQQPHARQQNTKEKKKQQVSTRRNTPHKHENKQKERKRAEQKERGTGAKQETERRRRQRGEQEKTQDKKNGEENERQSRRTKSERGQGEKEEREEEEEDRK

SEQ ID NO: 821841 - protein, 451 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHLKIEKECHAKIMIRGKGSVKEGKVGRQDGQMLPGRC

SEQ ID NO: 821842 - protein, 410 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGCGHP

SEQ ID NO: 821843 - protein, 410 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGRLHR

SEQ ID NO: 821844 - protein, 558 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPQGASMVVLLHGYGNKEQSSSATTVRQKKYGTKLPPAMEERYSPEEARPRQEEGGFPGLGTLTEKVRTPRGQEVGDS

SEQ ID NO: 821845 - protein, 363 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPLVVRKNHSRSHVYTRAAPW

SEQ ID NO: 821846 - protein, 111 aa, Homo sapiens
MATGANATPLDFPSKKRKRSRWNQDTMEQKTVIPGMPTVIPPGLTREQERAYIVQLQIEDLTRKLRTGDLGIPPNPEDRLGNSFNQLTVTLLPFSQYVLLVATYCVSSIKS

SEQ ID NO: 821847 - protein, 124 aa, Homo sapiens
PGDPQSAQDKARMDKEYLSLMAELGEAPVPASVGSTSGPATTPLASAPRPAAPANNPPPPVSLGAGSLGLASPFSTAETGSYGHVVWVEQTMDVDGNIVLPGSQASLGTSHFGKTLFLCSGPVS

SEQ ID NO: 821848 - protein, 493 aa, Homo sapiens
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 821849 - protein, 307 aa, Homo sapiens
QAVRPGIMGWANMAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECRVFKTDMELEVLRYTNKISSEAHREVMKAVKSGNEKIELEKLFEALIGTSRRDWPQFQNQLWGVVKSTLFNKDPDPSDKAKGYSVDGGIRGAKLAFEEYGTRLEGPTDNVEP

SEQ ID NO: 821850 - protein, 529 aa, Homo sapiens
GGTSRDAGAGRTWRRPPGECCASLALSRWRGEGHVVSRPDRGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 821851 - protein, 452 aa, Homo sapiens
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 821852 - protein, 493 aa, Homo sapiens; identical to SEQ ID NO: 821848

SEQ ID NO: 821853 - protein, 304 aa, Homo sapiens [sequence omitted]

SEQ ID NO: 821854 - protein, 339 aa, Homo sapiens
MGVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 821855 - protein, 357 aa, Homo sapiens
MPWALTWGPSLCLQLLPAASLWTVLSAFLGSRFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 821856 - protein, 348 aa, Homo sapiens
MLWHAVCRRMGSVRDGSFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 821857 - protein, 186 aa, Homo sapiens
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECWEL

SEQ ID NO: 821858 - protein, 114 aa, Homo sapiens
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKLPAS

SEQ ID NO: 821859 - protein, 126 aa, Homo sapiens
MKLLVPGIVLFDPFKCLCSTLHLGLRLTSSSNRSSGLASWFDLMGPPSSPYPLACREEELVVDSGPHLSTQPIPLGPWSSWMVGPGPLQVWLLGVPGLGSVPFGLSLGLRPPSTSPDQGQAACCLQ

SEQ ID NO: 821860 - protein, 256 aa, Homo sapiens
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYSIDNEALYDILLPHPEADHPPHYGDLNHLVSATMSGVTTCLRFPGQLNADLRKLGR

SEQ ID NO: 821861 - protein, 250 aa, Homo sapiens
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHTAVNTDLIDTPDTLSHLSYTHYGTTVGTYWYTLLRHYNSTRNVSRYLSAYTGQTPSHTQL

SEQ ID NO: 821862 - protein, 124 aa, Homo sapiens
MDQVLPERRAMRVQGYPLPRKQDMAREEGKECCAAARQLELMNSPKMEKLMKVTVLSLIKILNGLGAVAYTCNPSTLQGEFEEEEGEDEALKNFSDQSCILSELLLSSSMVFLLVNYGAQFCLC

SEQ ID NO: 821863 - protein, 256 aa, Homo sapiens; identical to SEQ ID NO: 821860

SEQ ID NO: 821864 - protein, 256 aa, Homo sapiens; identical to SEQ ID NO: 821860

SEQ ID NO: 821865 - protein, 256 aa, Homo sapiens; identical to SEQ ID NO: 821860

SEQ ID NO: 821866 - protein, 256 aa, Homo sapiens; identical to SEQ ID NO: 821860

SEQ ID NO: 821867 - protein, 256 aa, Homo sapiens; identical to SEQ ID NO: 821860

SEQ ID NO: 821868 - protein, 256 aa, Homo sapiens; identical to SEQ ID NO: 821860

SEQ ID NO: 821869 - protein, 256 aa, Homo sapiens; identical to SEQ ID NO: 821860

SEQ ID NO: 821870 - protein, 256 aa, Homo sapiens; identical to SEQ ID NO: 821860

SEQ ID NO: 821871 - protein, 256 aa, Homo sapiens; identical to SEQ ID NO: 821860

SEQ ID NO: 821872 - protein, 187 aa, Homo sapiens
MFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEALKNFSDQSCILSELLLSSSMVFLLVNYGAQFCLC

SEQ ID NO: 821873 - protein, 187 aa, Homo sapiens; identical to SEQ ID NO: 821872

SEQ ID NO: 821874 - protein, 143 aa, Homo sapiens
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHIPPVTASMTMRWKVRNGTCLQTSLQHPSRQSQLQTNHPQDSFRLSL

SEQ ID NO: 821875 - protein, 106 aa, Homo sapiens
FVSGAVAASGLAAKGFSWDESGSSAFILDAHPALAPAAFGPARVPGDSRISEDTGRERLAILSPAEEQTFAFQVQNYRHARAHTQAHAEREEPCRSEAALRVPSCA

SEQ ID NO: 821876 - protein, 40 aa, Homo sapiens
MTVNSEEEEDLDLSAFGSELLRVWSVYYIKEGVSTLISEI

SEQ ID NO: 821877 - protein, 286 aa, Homo sapiens
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPITDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLP

SEQ ID NO: 821878 - protein, 111 aa, Homo sapiens
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDMLHK

SEQ ID NO: 821879 - protein, 223 aa, Homo sapiens
MEVEPSPTSPAPLIQAEHSYSLCEEPRAQSPFTHITTSDSFNDDEVESEKWYLSTDFPSTSIKTEPITDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLP

SEQ ID NO: 821880 - protein, 240 aa, Homo sapiens
CSRGSQQHWTRESGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRVQCCWDPLDTSRH

SEQ ID NO: 821881 - protein, 1520 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 821882 - protein, 1326 aa, Homo sapiens
CSRGSQQHWTRESGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 821883 - protein, 1520 aa, Homo sapiens; identical to SEQ ID NO: 821881

SEQ ID NO: 821884 - protein, 1431 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELVGDRPTTLNSVSLLKFLKKV

SEQ ID NO: 821885 - protein, 1435 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLVCHVEEV

SEQ ID NO: 821886 - protein, 434 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRVQCCWDPLDTSRH

SEQ ID NO: 821887 - protein, 950 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPAEFLKPSDSFSAGEPRVLGLAMVPGHHIVSIEVQRESLTGPPYL

SEQ ID NO: 821888 - protein, 905 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPVWENVCSENEMVSTLYVSMLFDFF

SEQ ID NO: 821889 - protein, 814 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 821890 - protein, 671 aa, Homo sapiens
MKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 821891 - protein, 260 aa, Homo sapiens
CSRGSQQHWTRESGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDHLALSPDCFQASPTLCPGYLLLCSSSLDYLLFYPSSYPESLLASPILGLD

SEQ ID NO: 821892 - protein, 338 aa, Homo sapiens
ATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPRTAVR

SEQ ID NO: 821893 - protein, 107 aa, Homo sapiens
YDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLR

SEQ ID NO: 821894 - protein, 232 aa, Homo sapiens
GVRYTRKCLQGEEAGGLTAMGRNKKKKRDGDDRRPRLVLSFDEEKRREYLTGFHKRKVERKKAAIEEIKQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 821895 - protein, 232 aa, Homo sapiens; identical to SEQ ID NO: 821894

SEQ ID NO: 821896 - protein, 232 aa, Homo sapiens; identical to SEQ ID NO: 821894

SEQ ID NO: 821897 - protein, 232 aa, Homo sapiens; identical to SEQ ID NO: 821894

SEQ ID NO: 821898 - protein, 232 aa, Homo sapiens; identical to SEQ ID NO: 821894

SEQ ID NO: 821899 - protein, 232 aa, Homo sapiens; identical to SEQ ID NO: 821894

SEQ ID NO: 821900 - protein, 187 aa, Homo sapiens [sequence omitted]

SEQ ID NO: 821901 - protein, 143 aa, Homo sapiens [sequence omitted]

SEQ ID NO: 821902 - protein, 247 aa, Homo sapiens
PETASEAWLQMECPLLDIGEHVPQAALPCPQFTHIDSPPTLADTHRTLGLGPQPGRGKSWGREYLTGFHKRKVERKKAAIEEIKQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 821903 - protein, 202 aa, Homo sapiens [sequence omitted]

SEQ ID NO: 821904 - protein, 175 aa, Homo sapiens
AACDLEEPVSFQQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 821905 - protein, 232 aa, Homo sapiens; identical to SEQ ID NO: 821894

SEQ ID NO: 821906 - protein, 232 aa, Homo sapiens; identical to SEQ ID NO: 821894

SEQ ID NO: 821907 - protein, 103 aa, Homo sapiens
HFSSGVAWGAAAWVARWGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 821908 - protein, 232 aa, Homo sapiens; identical to SEQ ID NO: 821894

SEQ ID NO: 821909 - protein, 232 aa, Homo sapiens; identical to SEQ ID NO: 821894

SEQ ID NO: 821910 - protein, 248 aa, Homo sapiens
GVRYTRKCLQGEEAGGLTAMGRNKKKKRDGDDRRPRLVLSFDEEKRREYLTGFHKRKVERKKAAIEEIKQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRLCLCVGGGVWWVVWCVGGCVCVVWWWGG

SEQ ID NO: 821911 - protein, 224 aa, Homo sapiens
MAPPAAPGRDRVGREDEDGWETRGDRKARKPLVEKKRRARINESLQELRLLLAGAEVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 821912 - protein, 224 aa, Homo sapiens; identical to SEQ ID NO: 821911

SEQ ID NO: 821913 - protein, 224 aa, Homo sapiens; identical to SEQ ID NO: 821911

SEQ ID NO: 821914 - protein, 121 aa, Homo sapiens
MHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 821915 - protein, 195 aa, Homo sapiens
MAPPAAPGRDRVGREDEDGWETRGDRKVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 821916 - protein, 228 aa, Homo sapiens
MDSVKPAAVNDGSTITLPVPAAPSPCRVPGGAGMAPPAAPGRDRVGREDEDGWETRGDRKVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 821917 - protein, 250 aa, Homo sapiens
MAPPAAPGRDRVGREDEDGWETRGDRKVRAGAMGEQSGREAVRGWDSVPRSPQARKPLVEKKRRARINESLQELRLLLAGAEVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 821918 - protein, 121 aa, Homo sapiens; identical to SEQ ID NO: 821914

SEQ ID NO: 821919 - protein, 121 aa, Homo sapiens; identical to SEQ ID NO: 821914

SEQ ID NO: 821920 - protein, 121 aa, Homo sapiens; identical to SEQ ID NO: 821914

SEQ ID NO: 821921 - protein, 186 aa, Homo sapiens
MAPPAAPGRDRVSWVSRVPAGRVGWATQSPLTARDAALSLPPSGPEREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 821922 - protein, 121 aa, Homo sapiens; identical to SEQ ID NO: 821914

SEQ ID NO: 821923 - protein, 214 aa, Homo sapiens
MAPPAAPGRDRVGREDEDGWETRGDRKARKPLVEKKRRARINESLQELRLLLAGAEVQAKLENAEVLELTVRRVQGVLRGRARGEWRRGGRGRRPRAPVTPARRRTSLPAPLSCRRRGLPPEQGAPPRLLGEPRPRGPGGLGHAVAAHRAGRGSLPPTLGPRARAAAGGSERALRCRLHPVHARGAHVRVHVPGHRRYRRCRAPEPSARVHAAA

SEQ ID NO: 821924 - protein, 112 aa, Homo sapiens
MAPPAAPGRDRVGREDEDGWETRGDRKVQAKLENAEVLELTVRRVQGVLRGRAREREQLQAEASERFAAGYIQCMHEVHTFVSTCQAIDATVAAELLNHLLESMPLREGSPW

SEQ ID NO: 821925 - protein, 106 aa, Homo sapiens
MAPPAAPGRDRVGREDEDGWETRGDRKARKPLVEKKRRARINESLQELRLLLAGAEVQAKLENAEVLELRRKNFVELPALSQVHPPRLHQPCAGSGGRGGRNGAGH

SEQ ID NO: 821926 - protein, 248 aa, Homo sapiens
ASDERPIFQHAQEKIYIKVDVFFKWVFALLFSFLPNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821927 - protein, 412 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821928 - protein, 195 aa, Homo sapiens
GPRGPLPSLPTLGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821929 - protein, 324 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVAVLTRGNVHWMKSGVLETRAFLPALDGAPGRGATQAGNGRVGWALFSVPRGGVRDRPQGGG

SEQ ID NO: 821930 - protein, 324 aa, Homo sapiens
VPGQIHTQGCARNRYTPARFWHSPECEFVRHCIAKSQERVEGKVQVSVLKGQVYILGRESQLLIVERQPAPWLVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKGNNQIRKTSYAQHQQVRKIRKKMMAIMTREVQTNDLKKWSIMIRPAWEDKKGGIYIFRRFVKVNAGSQLMGTWLGEGIAPGHRSDVVNPHCPGTLGNKRSAEKGPGLE

SEQ ID NO: 821931 - protein, 412 aa, Homo sapiens; identical to SEQ ID NO: 821927

SEQ ID NO: 821932 - protein, 412 aa, Homo sapiens; identical to SEQ ID NO: 821927

SEQ ID NO: 821933 - protein, 412 aa, Homo sapiens; identical to SEQ ID NO: 821927

SEQ ID NO: 821934 - protein, 412 aa, Homo sapiens; identical to SEQ ID NO: 821927

SEQ ID NO: 821935 - protein, 412 aa, Homo sapiens; identical to SEQ ID NO: 821927

SEQ ID NO: 821936 - protein, 412 aa, Homo sapiens; identical to SEQ ID NO: 821927

SEQ ID NO: 821937 - protein, 412 aa, Homo sapiens; identical to SEQ ID NO: 821927

SEQ ID NO: 821938 - protein, 412 aa, Homo sapiens; identical to SEQ ID NO: 821927

SEQ ID NO: 821939 - protein, 452 aa, Homo sapiens
MGTPASPALPPATAARARVVHCTVKTDSRRRELTPPIPDAMSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821940 - protein, 412 aa, Homo sapiens; identical to SEQ ID NO: 821927

SEQ ID NO: 821941 - protein, 412 aa, Homo sapiens; identical to SEQ ID NO: 821927

SEQ ID NO: 821942 - protein, 412 aa, Homo sapiens; identical to SEQ ID NO: 821927

SEQ ID NO: 821943 - protein, 488 aa, Homo sapiens [sequence omitted]

SEQ ID NO: 821944 - protein, 484 aa, Homo sapiens
MDHGTKLFSDLRFQSDVRRGPWCLVTLGVGHTYRARGLAGIASAMTYHRRVVHCTVKTDSRRRELTPPIPDAMSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821945 - protein, 438 aa, Homo sapiens
TRRGLGPRQEGRGSRCSNAWHRIPDAMSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821946 - protein, 311 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVFLAQP

SEQ ID NO: 821947 - protein, 400 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVLGDNITDLSPNTEIFNAGLVV

SEQ ID NO: 821948 - protein, 445 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVACVSAALSGLLGTAVSGEHEPGPLQLMVVAEAQGGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821949 - protein, 315 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVHCLSTMRSW

SEQ ID NO: 821950 - protein, 410 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTVLATALSVKADVFMYLNEVAGKHGVAVLTRGNLFRSELKVPEVSTRTREGTSFTHAHVDIEAFTMDRGTCAKIRQGLGSKLRELVYT

SEQ ID NO: 821951 - protein, 315 aa, Homo sapiens; identical to SEQ ID NO: 821949

SEQ ID NO: 821952 - protein, 266 aa, Homo sapiens [sequence omitted]

SEQ ID NO: 821953 - protein, 237 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKAPWSSSCT

SEQ ID NO: 821954 - protein, 422 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISCPCLSFPLRSYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821955 - protein, 246 aa, Homo sapiens
MDRGEGCRSPREVGCRVSRDWYVICPPLSVFFQNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821956 - protein, 326 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVAVLTRGNGPLDEVRGFSRPEAFLPALDGAPGRGATQAGNGRVPVGPCFPSRRGGVRDRPQGGG

SEQ ID NO: 821957 - protein, 161 aa, Homo sapiens [sequence omitted]

SEQ ID NO: 821958 - protein, 310 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAASWGPVDSGATVLDEPRIETRGTFMALKGYRRGDKRGDGGSVGVVRVSGGGQ

SEQ ID NO: 821959 - protein, 195 aa, Homo sapiens; identical to SEQ ID NO: 821928

SEQ ID NO: 821960 - protein, 189 aa, Homo sapiens
DRRCSRRVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821961 - protein, 161 aa, Homo sapiens [sequence omitted]

SEQ ID NO: 821962 - protein, 161 aa, Homo sapiens
WTSSSHRGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 821963 - protein, 253 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKACEGPRQVDTTDSEALSESRHMVA

SEQ ID NO: 821964 - protein, 268 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGYVPTCWDSKGVDFWGPGSFPLPAWEPRPSLPPPCIPGS

SEQ ID NO: 821965 - protein, 128 aa, Homo sapiens
VPVKVTNVKDGTTHQTSLELFMEAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWT

SEQ ID NO: 821966 - protein, 126 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKHERAG

SEQ ID NO: 821967 - protein, 132 aa, Homo sapiens
MDHGTKLFSDLRFQSDVRRGPWCLVTLGVGHTYRARGLAGIASAMTYHRRVVHCTVKTDSRRRELTPPIPDAMSSKGSVVLAYSGGLDTSCILVWLKEQGYDVIAYLANIGQKEDFEEARKKALKLGAKKVH

SEQ ID NO: 821968 - protein, 143 aa, Homo sapiens
MAMHFIFSDTAVLLFDFWSVHSPAGMALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVVLGSAVGYYLAYPLLSTA

SEQ ID NO: 821969 - protein, 143 aa, Homo sapiens; identical to SEQ ID NO: 821968

SEQ ID NO: 821970 - protein, 118 aa, Homo sapiens
MALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVVLGSAVGYYLAYPLLSTA

SEQ ID NO: 821971 - protein, 93 aa, Homo sapiens
YEDQAKCLSTAFYSLISTPSFLITSSLPGLTCFSFLSRWYLCHFGQSLIHVIQVVIGYFIMLAVMSYNTWIFLGVVLGSAVGYYLAYPLLSTA

SEQ ID NO: 821972 - protein, 143 aa, Homo sapiens; identical to SEQ ID NO: 821968

SEQ ID NO: 821973 - protein, 92 aa, Homo sapiens
AARVAIAAAAAAAVELTRSEETRASRRGPGARPAHSPWRCISSSQIQRCFCLISGVSTVLLAWPFRCWCSCFWLYCMKASRLAKPSCSTRYW

SEQ ID NO: 821974 - protein, 135 aa, Homo sapiens
MAMHFIFSDTAVLLFDFWSVHSPAGMALSVLVLLLLAVLYEGIKVGKAKLLNQVLVNLPTSISQQTIAETDGDSAGSDSFPVGRTHHRYRQWVWERGRSLTFTLRDRLAQTALAPLHREDSEAQGRTRTCQSGYT

SEQ ID NO: 821975 - protein, 54 aa, Homo sapiens
MALSVLVLLLLAVLYEGIKVGKAKLLNQVLVNLPTSISQQTIAETDGDSAGSDS

SEQ ID NO: 821976 - protein, 167 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRREG

SEQ ID NO: 821977 - protein, 685 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 821978 - protein, 685 aa, Homo sapiens; identical to SEQ ID NO: 821977

SEQ ID NO: 821979 - protein, 132 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKVRMTLE

SEQ ID NO: 821980 - protein, 519 aa, Homo sapiens [sequence omitted]

SEQ ID NO: 821981 - protein, 425 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEVCWERVK

SEQ ID NO: 821982 - protein, 387 aa, Homo sapiens [sequence omitted]

SEQ ID NO: 821983 - protein, 115 aa, Homo sapiens
ADLEDPRLVQPYLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 821984 - protein, 207 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRLQGSQKNDLEYVEEDGHVVVRKQFPCGLLDWVEPEQAKAYSS

SEQ ID NO: 821985 - protein, 447 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEEAPMLFKGCNWSSFWLRNCELWPYIIFFH

SEQ ID NO: 821986 - protein, 142 aa, Homo sapiens
MGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 821987 - protein, 327 aa, Homo sapiens
MTVVSVPQREPLVLGGRLAPLGFSSRGYFGALPMVTTAPPPLPRIPDPRALPPTLFLPHFLGGDGPCLTPQPRAPAALPNRSLAVAGGTPRAAPKKRRKKKVRASPAGQLPSRFHQYQQHRPSLEGGRSPATGPSGAQEVPGPAAALAPSPAAAAGTEGASPDLAPLRPAAPGQTPLRKEVLKSKMGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 821988 - protein, 327 aa, Homo sapiens; identical to SEQ ID NO: 821987

SEQ ID NO: 821989 - protein, 271 aa, Homo sapiens
TPSYPVRPRTPHLSPHSREWPFYPSVQLPTLRVRSTFGARRARREVRASPAGQLPSRFHQYQQHRPSLEGGRSPATGPSGAQEVPGPAAALAPSPAAAAGTEGASPDLAPLRPAAPGQTPLRKEVLKSKMGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 821990 - protein, 142 aa, Homo sapiens; identical to SEQ ID NO: 821986

SEQ ID NO: 821991 - protein, 278 aa, Homo sapiens
MTVVSVPQREPLVLGGRLAPLGFSSRGYFGALPMVTTAPPPLPRIPDPRALPPTLFLPHFLGGDGPCLTPQPRAPAALPNRSLAVAGGTPRAAPKKRRKKKVRASPAGQLPSRFHQYQQHRPSLEGGRSPATGPSGAQEVPGPAAALAPSPAAAAGTEGASPDLAPLRPAAPGQTPLRKEVLKSKMGKSEKIALPHGQLVHGIHLYEQPKINRQKSKYNLPLTKITSAKRNENNFWQDSVSSDRIQKQEKKPFKNTENIKNSHLKKSAFLTEVSQKEN

SEQ ID NO: 821992 - protein, 327 aa, Homo sapiens; identical to SEQ ID NO: 821987

SEQ ID NO: 821993 - protein, 327 aa, Homo sapiens; identical to SEQ ID NO: 821987

SEQ ID NO: 821994 - protein, 142 aa, Homo sapiens; identical to SEQ ID NO: 821986

SEQ ID NO: 821995 - protein, 327 aa, Homo sapiens; identical to SEQ ID NO: 821987

SEQ ID NO: 821996 - protein, 227 aa, Homo sapiens; identical to SEQ ID NO: 814765

SEQ ID NO: 821997 - protein, 227 aa, Homo sapiens; identical to SEQ ID NO: 814765

SEQ ID NO: 821998 - protein, 227 aa, Homo sapiens; identical to SEQ ID NO: 814765

SEQ ID NO: 821999 - protein, 227 aa, Homo sapiens; identical to SEQ ID NO: 814765

SEQ ID NO: 822000 - protein, 972 aa, Homo sapiens
MAGRVPSLLVLLVFPSSCLAFRSPLSVFKRFKETTRPFSNECLGTTRPVVPIDSSDFALDIRMPGVTPKQTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822001 - protein, 867 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822002 - protein, 992 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGARREDMKCFQCKEMISVQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822003 - protein, 885 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQARREDMKCFQCKEMISVQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822004 - protein, 906 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKADSEHKLETSSGRVLGRFRGKGSGGLNLGNFFASRKGYSRKGFDRLSTEGSDQEKEDDGSESEEEYSAPLPALAPSSS

SEQ ID NO: 822005 - protein, 848 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGGKGSGGLNLGNFFASRKGYSRKGFDRLSTEGSDQEKEDDGSESEEEYSAPLPALAPSSS

SEQ ID NO: 822006 - protein, 477 aa, Homo sapiens
MEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822007 - protein, 791 aa, Homo sapiens
MSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822008 - protein, 770 aa, Homo sapiens
MDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822009 - protein, 887 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKGKGSGGLNLGNFFASRKGYSRKGFDRLSTEGSDQEKEDDGSESEEEYSAPLPALAPSSS

SEQ ID NO: 822010 - protein, 715 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKNWNIDQLKRLALRSRKSKKPRQLLKPKWRTNPPPQNCRRCKRNRN

SEQ ID NO: 822011 - protein, 768 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKETETDQRARLGSACCSHYNPSGYSGGCPAGHCHIYSVEKIKGLWSRF

SEQ ID NO: 822012 - protein, 989 aa, Homo sapiens
MAGRVPSLLVLLVFPSSCLAFRSPLSVFKRFKETTRPFSNECLGTTRPVVPIDSSDFALDIRMPGVTPKQTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSSCFPLARLKFCVFNCKLY

SEQ ID NO: 822013 - protein, 713 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKNWNIDQLKRLALRSRKSKQILNTNSRRVQEEYWEDLEEREVEA

SEQ ID NO: 822014 - protein, 194 aa, Homo sapiens
MPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 822015 - protein, 972 aa, Homo sapiens; identical to SEQ ID NO: 822000

SEQ ID NO: 822016 - protein, 76 aa, Homo sapiens
ARSYAENNCMRGNRDCERKGSGGLNLGNFFASRKGYSRKGFDRLSTEGSDQEKEDDGSESEEEYSAPLPALAPSSS

SEQ ID NO: 822017 - protein, 720 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTESMVFTVLLFTFSLSLIA

SEQ ID NO: 822018 - protein, 426 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFPRALN

SEQ ID NO: 822019 - protein, 261 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQ

SEQ ID NO: 822020 - protein, 245 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLEGRL

SEQ ID NO: 822021 - protein, 150 aa, Homo sapiens
MAGRVPSLLVLLVFPSSCLAFRSPLSVFKRFKETTRPFSNECLGTTRPVVPIDSSDFALDIRMPGVTPKQASLTLSLNLTAEGEKTNSLLGTSWWDIYYTLFEKMDPSSSRSSCAIAGKCLKKIPIQLQEPHGFPYHLCVVSSHGPAYLP

SEQ ID NO: 822022 - protein, 105 aa, Homo sapiens
MFFAGMTWNFTTVTSCEVTRAEKAHCIVAKQFWLSKLQLEVVISKTNHSLWGRYFRNYIYSLSFECLLVYNSSKNKILGYISVEEKQIIDCNSSQGNTELYTNAS

SEQ ID NO: 822023 - protein, 174 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIGNARSCLVFNPLLLDI

SEQ ID NO: 822024 - protein, 952 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 822025 - protein, 981 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 822026 - protein, 952 aa, Homo sapiens; identical to SEQ ID NO: 822024

SEQ ID NO: 822027 - protein, 235 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKKPLEQSC

SEQ ID NO: 822028 - protein, 150 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKCQHSKNGRKESKDISRKYDGIKIQEKQQTIETDP

SEQ ID NO: 822029 - protein, 107 aa, Homo sapiens
MLWGRAAAVAATSPTASGRRWRKAERRIWTPSGLTSRRCSKPRSGKGTPGKRKGLRCPRLPEDSGEVGGSRELVLSLVTGAGRSGGGRRGSGILAASEMLGQRLDSR

SEQ ID NO: 822030 - protein, 1029 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQFRFTKIVSIHDHLRIGLLEHLNRKGVVHIQHYKRQLSLFEGDYLAIFQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 822031 - protein, 1029 aa, Homo sapiens; identical to SEQ ID NO: 822030

SEQ ID NO: 822032 - protein, 1029 aa, Homo sapiens; identical to SEQ ID NO: 822030

SEQ ID NO: 822033 - protein, 908 aa, Homo sapiens
MFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQFRFTKIVSIHDHLRIGLLEHLNRKGVVHIQHYKRQLSLFEGDYFGYFQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 822034 - protein, 462 aa, Homo sapiens
MIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 822035 - protein, 911 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQFRFTKIVSIHDHLRIGLLEHLNRKGVVHIQHYKRQLSLFEGDYLAIFQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPIKYCFCKK

SEQ ID NO: 822036 - protein, 215 aa, Homo sapiens
MDHISKYKTIKLLEGNTGQTLVYEMFPSDTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 822037 - protein, 1003 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQFRFTKIVSIHDHLRIGLLEHLNRKGVVHIQHYKRQLSLFEGDYLAIFQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVCWAHNPLKASESRREVCWCTCGKFFWRKEKMILL

SEQ ID NO: 822038 - protein, 199 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPAVRRGVPSS

SEQ ID NO: 822039 - protein, 122 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVHFNNN

SEQ ID NO: 822040 - protein, 90 aa, Homo sapiens
DEPDDESSQDQELPSENENSQSEDSVGGDNDSENGLCTEDTCKGQLTGHKKRLFTFQFNNLGNTDINYIKDDTRHIRFDDRQLRLDGKYL

SEQ ID NO: 822041 - protein, 1536 aa, Homo sapiens
MCKNSMKDPSFLISFDIVIFFSTLKKIGFCIFISADDIWVPKRAALIYFSYLWEKYYKFGEIVMFIVFPSTFVTTAGLLRTAAVGQQDWHLLQRLYLMILLCSIPDLLGNVIYDIQICIISRNIIGLILHYSCIEASMLEEIFCVYLLFLFLNFLKNYLRYGFGVKWVLLAVSSIYPNLTSTYVRLSIWLNFKVIHLSPLCMIFTKCQFSFAYSSFYFSLFSIHGIKISDFWGWGRNVPKSDNRAFYKFLQRKYRQIDKIYFYGEEIWPYYGFVFFLLSKIAGLTLLYEVSLELLKKKKVCTIIFHGCIQMYIFKEKYFLCPHSKMSWDKYEIVYEVAFLVQSDWTKVCILSGYQEKEFLWKSLVSINNPCKPCLHYAKTSGKMGRVILSQDVKNLGLTDSPTFHTVYSCDFCFSVDPESVLQESCFYFGLRNTRCKSYNFLFVLYHDLGFLFSFTFFTALEYFLFFSLVTKIKIKLYFYELKGNLIYFYELKIVASIHCVLRLRSTNLEEPVCGILKRRYCGFIFSSFSPLISGKLENFQRGNENHLNRIHVSFSELVKILATDPVTPGQTSYNITGHNASLYLMEMAELCGSCCEYLGLTVIENLIYTIQTQQLRKTALIAFSYVVTKYKYVKLRIMITYATLVIGIDDNFPVLFQISDCSAGIHWIIIYNVTIILCFSILMSDVNNIKLAVCSSSVSKKYIELHKYQFIFKHTELKILTEIINSEETSPSLSLIISLNTFLFLNNPNYCLFNYESTVFIYMGSTGIYQTSTVCPALPSTVGEHQFAVVVSALEGIFSRKLAVLFSLLSKHEQKRTCSLKNMLTFLVSTEICHCRSESNFTIKEMLQLGNEYGHTGTWCSMQGSRRPGLLSKFCHLGISCVTLNKSLTLSLSFLICKFGLSVYYDNQLRKSLNTSYIQRTYHKLKLAINAPLYIFLNENNTIHDVYFISNICPGHATLKIRGISNKVLDENQISCLNGRKMKLFMDKRVRMCILKYVKMIELKDGFRFFLRIRKVPSPQIQHTLQVLDKGEGSHGIENDLATPQGTCGENEVVRKVRMHKDSSGLGTTVCLVERNQCRKGDATRHLQQTRFFLPFSKDALCSSKTIDRVDWNIMGPSMLLLGIIIKNSFFSLNIVNCSPHKEKLELTSLGGVLDLPLKQSWEAGSSVFSLDRVSLVNKGDTGNPEWTVICVGRHSGSGALILCFLKQPPVFGLPYEMMFMCFLETRWKERGRINFLILLLLNVMNLNTVAFLEALPSFSCCKVKYLISLTEILKIKVIEEANVYFQSNELVVTVILFFYSIFFLILTERRKEYSFAISLGSPLPPGAPSSVLRLCLNKYNIYILLLKPFETVFSDSSKFDLLCTISLINPGYHVALDLQVVYLCKTCDTLNSLLFLSESSHKWSLIIKVKLVSNQFHLAISFSKCQLFSSKIFHQNNDHKLLEYIILCRHKITQTYSHISLVYFGWSNLPALNVKYNEELIPYLELFLPFKIHKYTFYFYRATYNFHITVRDLRCNLLSEPQGYFILQKKPKPN

SEQ ID NO: 822042 - protein, 1536 aa, Homo sapiens; identical to SEQ ID NO: 822041

SEQ ID NO: 822043 - protein, 728 aa, Homo sapiens
FMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGKRPKKGMATAKQRLGKILKLNRNGHARFFV

SEQ ID NO: 822044 - protein, 708 aa, Homo sapiens
MNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGNFHTCIEKVYF

SEQ ID NO: 822045 - protein, 200 aa, Homo sapiens
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 822046 - protein, 200 aa, Homo sapiens; identical to SEQ ID NO: 822045

SEQ ID NO: 822047 - protein, 200 aa, Homo sapiens; identical to SEQ ID NO: 822045

SEQ ID NO: 822048 - protein, 69 aa, Homo sapiens
LGQGEVCEAKDVAHRKMAWSGVSFASAHLTLTEPYRGGCQAQDYTGGMGIVNGAKWNPRTGSESAWEGL

SEQ ID NO: 822049 - protein, 1158 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822050 - protein, 1158 aa, Homo sapiens; identical to SEQ ID NO: 822049

SEQ ID NO: 822051 - protein, 1192 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMVGTMPRLLALLPLSGRGVGSQRGWQSALRPASPQTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822052 - protein, 901 aa, Homo sapiens
MGASPKPSLPFPNEGTAVGPGLWKSGAWSEWVQFEGPVLEALREMLDCAWVPNHDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822053 - protein, 769 aa, Homo sapiens
MESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822054 - protein, 1158 aa, Homo sapiens; identical to SEQ ID NO: 822049

SEQ ID NO: 822055 - protein, 790 aa, Homo sapiens
YCYLVGYCYLVEEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822056 - protein, 785 aa, Homo sapiens
DTRTSYESSSECPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822057 - protein, 737 aa, Homo sapiens
EDPCSDHCPLHSDDFVTTFFVGFSNDSQTWVMYTNGYEEMVGTMPRLLALLPLSGRGVGSQRGWQSALRPASPQTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822058 - protein, 412 aa, Homo sapiens
TTSRGYPHEAEVGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822059 - protein, 1158 aa, Homo sapiens; identical to SEQ ID NO: 822049

SEQ ID NO: 822060 - protein, 317 aa, Homo sapiens
SLGTRHGAQVKPPDGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822061 - protein, 308 aa, Homo sapiens
AVPDRMCRHNYELDEAVTLQRRVQPKVNVSPSKKGPQQHHQDILVVLLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822062 - protein, 681 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 822063 - protein, 69 aa, Homo sapiens
KLVAYVICWVTELDVRHQWDDALCRAVIEDILEPEFEEEEEEEKEEEIATGQAFPFTTVETYTVNFGDF

SEQ ID NO: 822064 - protein, 639 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGAAEIYDTPAEYLISTDVLASQLYLF

SEQ ID NO: 822065 - protein, 551 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVARECGGLAG

SEQ ID NO: 822066 - protein, 1088 aa, Homo sapiens [sequence omitted]

SEQ ID NO: 822067 - protein, 1088 aa, Homo sapiens [sequence omitted]

SEQ ID NO: 822068 - protein, 1001 aa, Homo sapiens
MQRYGCRERSLERSPRLERHCPPGALQEMAGRALKQTGSRSIEAALEYISKMGYLDPRNEQIVRVIKQTSPGKGLMPTPVTRRPSFEGTGDSFASYHQLSGTPYEGPSFGADGPTALEEMPRPYVDYLFPGVGPHGPGHQHQHPPKGYGASVEAAGAHFPLQGAHYGRPHLLVPGEPLGYGVQRSPSFQSKTPPETGGYASLPTKGQGGPPGAGLAFPPPAAGLYVPHPHHKQAGPAAHQLHVLGSRSQVFASDSPPQSLLTPSRNSLNVDLYELSSTSVQQWPAATLARRDSLQKPGLEAPPRAHVAFRPDCPVPSRTNSFNSHQPRPGPPGKAEPSLPAPNTVTAVTAAHILHPVKSVRVLRPEPQTAVGPSHPAWVPAPAPAPAPAPAPAAEGLDAKEEHALALGGAGAFPLDVEYGGPDRRCPPPPYPKHLLLRSKSEQYDLDSLCAGMEQSLRAGPNEPEGGDKSRKSAKGDKGGKDKKQIQTSPVPVRKNSRDEEKRESRIKSYSPYAFKFFMEQHVENVIKTYQQKVNRRLQLEQEMAKAGLCEAEQEQMRKILYQKESNYNRLKRAKMDKSMFVKIKTLGIGAFGEVCLACKVDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGSHVRQDSMEPSDLWDDVSNCRCGDRLKTLEQRARKQHQRCLAHSLVGTPNYIAPEVLLRKGYTQLCDWWSVGVILFEMLVGQPPFLAPTPTETQLKVINWENTLHIPAQVKLSPEARDLITKLCCSADHRLGRNGADDLKAHPFFSAIDFSSDIRKQPAPYVPTISHPMDTSNFDPVDEESPWNDASEGSTKAWDTLTSPNNKHPEHAFYEFTFRRFFDDNGYPFRCPKPSGAEASQAESSDLESSDLVDQTEGCQPVYV

SEQ ID NO: 822069 - protein, 304 aa, Homo sapiens [sequence omitted]

SEQ ID NO: 822070 - protein, 178 aa, Homo sapiens
MCGETNLLALLFPQVINWENTLHIPAQVKLSPEARDLITKLCCSADHRLGRNGADDLKAHPFFSAIDFSSDIRKQPAPYVPTISHPMDTSNFDPVDEESPWNDASEGSTKAWDTLTSPNNKHPEHAFYEFTFRRFFDDNGYPFRCPKPSGAEASQAESSDLESSDLVDQTEGCQPVYV

SEQ ID NO: 822071 - protein, 1088 aa, Homo sapiens [sequence omitted]

SEQ ID NO: 822072 - protein, 399 aa, Homo sapiens
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 822073 - protein, 399 aa, Homo sapiens; identical to SEQ ID NO: 822072

SEQ ID NO: 822074 - protein, 399 aa, Homo sapiens; identical to SEQ ID NO: 822072

SEQ ID NO: 822075 - protein, 281 aa, Homo sapiens
MVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 822076 - protein, 389 aa, Homo sapiens
PRPCERPSLLHCSRRGAARLFTPNNGGSEPERRRRLRGRQRQRHPRPRRVPGARPPGRQQHAGERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 822077 - protein, 230 aa, Homo sapiens
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHREY

SEQ ID NO: 822078 - protein, 399 aa, Homo sapiens; identical to SEQ ID NO: 822072

SEQ ID NO: 822079 - protein, 399 aa, Homo sapiens; identical to SEQ ID NO: 822072

SEQ ID NO: 822080 - protein, 325 aa, Homo sapiens
LGRARGRACCIAAAAAPLGSSLPTMAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLVCLC

SEQ ID NO: 822081 - protein, 400 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 822082 - protein, 400 aa, Homo sapiens; identical to SEQ ID NO: 822081

SEQ ID NO: 822083 - protein, 440 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQPNHNPSLSPNPSLSPSSSTRIRIHIHIHTLILTRTHTLTRTRIRTKYRTHTHSRTRSRTGTGFSAAPPTLPERGSSRARQGFEDLRKWDEHISIVFTWIKSKTVSPPRTRSSSLDITLLKTCDSS

SEQ ID NO: 822084 - protein, 165 aa, Homo sapiens
MKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 822085 - protein, 366 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 822086 - protein, 390 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPQPHSQPHGHRLLRSTSNSA

SEQ ID NO: 822087 - protein, 299 aa, Homo sapiens
PTPTAALAAARAPASPQHLQLCLKGAAPGQDKVRSRHSRSRGVGLGGSELGGVGSLFTGSAPDGEIKTHTKFLGQWKKQKQAGARRAGQRGEAGEIRARQGASRTAPAPAPITTVLVPRSRCRWCSTRIVRPSWRSNPRGRSSSTWSSSSPPRSRSRSRSSSPNPSLSLSRNPSPNHNPSLSPNPSLSPSSSTRIRIHIHIHTLILTRTHTLTRTRIRTKYRTHTHSRTRSRTGTGFSAAPPTLPERGSSRARQGFEDLRKWDEHISIVFTWIKSKTVSPPRTRSSSLDITLLKTCDSS

SEQ ID NO: 822088 - protein, 400 aa, Homo sapiens; identical to SEQ ID NO: 822081

SEQ ID NO: 822089 - protein, 400 aa, Homo sapiens; identical to SEQ ID NO: 822081

SEQ ID NO: 822090 - protein, 400 aa, Homo sapiens; identical to SEQ ID NO: 822081

SEQ ID NO: 822091 - protein, 87 aa, Homo sapiens
YGRPCNPVQLLPSTIRDSVGSSTGFSAAPPTLPERGSSRARQGFEDLRKWDEHISIVFTWIKSKTVSPPRTRSSSLDITLLKTCDSS

SEQ ID NO: 822092 - protein, 108 aa, Homo sapiens
FTIITARLSHYYCYAGAGLFTRTRGYGITHTLRSLWTLVVKLCTGFSAAPPTLPERGSSRARQGFEDLRKWDEHISIVFTWIKSKTVSPPRTRSSSLDITLLKTCDSS

SEQ ID NO: 822093 - protein, 410 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQPNHNPSLSPNPSLSPSSSTRIRIHIHIHTLILTRTHTLTRTRIRTKYRTHTHSRTRSRTGTGFSAAPPTLPERGSSRARQGKVPALALPRSGSRG

SEQ ID NO: 822094 - protein, 445 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822095 - protein, 218 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGLT

SEQ ID NO: 822096 - protein, 182 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEER

SEQ ID NO: 822097 - protein, 435 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKVGCWGAARWVLWSGGDPAADLVAA

SEQ ID NO: 822098 - protein, 512 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERYVSAVRVGGCSEGYPQPQERGVAGMRVSLKHLATSEQPPVAEGELGWGYPRLLGCNCPRSGTESAPPGYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822099 - protein, 412 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERWSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822100 - protein, 445 aa, Homo sapiens; identical to SEQ ID NO: 822094

SEQ ID NO: 822101 - protein, 445 aa, Homo sapiens; identical to SEQ ID NO: 822094

SEQ ID NO: 822102 - protein, 445 aa, Homo sapiens; identical to SEQ ID NO: 822094

SEQ ID NO: 822103 - protein, 512 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERYVSAVRVGGCSEGYPQPQERGVAGMRVSLKHLATSEQPPEPEGELGWGYPRLLGCNCPRSGTESAPPGYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822104 - protein, 427 aa, Homo sapiens [sequence omitted]

SEQ ID NO: 822105 - protein, 417 aa, Homo sapiens
LGGGLASTASPPGSSIPYLLPLPGGEGQPQALASTCRALPVSLSQTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822106 - protein, 502 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERYVSAVRVGGCSEGYPQPQERGVAGMRVSLKHLATSEQPPVAEGELGWGYPRLLGCNCPRSGTESAPPGYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKVGCWGAARWVLWSGGDPAADLVAA

SEQ ID NO: 822107 - protein, 279 aa, Homo sapiens
MLGCNCPRSGTESAPPGYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822108 - protein, 340 aa, Homo sapiens
VQRIPLRICRAAARHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822109 - protein, 164 aa, Homo sapiens
MFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 822110 - protein, 435 aa, Homo sapiens; identical to SEQ ID NO: 822097

SEQ ID NO: 822111 - protein, 294 aa, Homo sapiens
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLQLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKVGSTRVGL

SEQ ID NO: 822112 - protein, 79 aa, Homo sapiens
MSKLPRELTRDLERSLPAVASLGSSLSHSQSLSSHLLPPPEKRRAISDVRRTFCLFVTFDLLFISLLWIIELNVSGGEV

SEQ ID NO: 822113 - protein, 111 aa, Homo sapiens
DGGGLTSQPLPSPSSLPPLGRSRRWCPVHSSLSRSSSLRSVAQGLASLVGIRPEWYASREEHFSNLGCLSLLSGLGGEGILSFGIYKESSFTRFPDLAPCSSRNQKVLSPA

SEQ ID NO: 822114 - protein, 481 aa, Homo sapiens
RQPDPAPPAPRSTPEAPAAPASAPLPPPPGAMGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 822115 - protein, 491 aa, Homo sapiens
RQPDPAPPAPRSTPEAPAAPASAPLPPPPGAMGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPRNPSALCSGSRLSEPLLPAGLEPGSPLRSFPGCRRRPH

SEQ ID NO: 822116 - protein, 481 aa, Homo sapiens; identical to SEQ ID NO: 822114

SEQ ID NO: 822117 - protein, 481 aa, Homo sapiens; identical to SEQ ID NO: 822114

SEQ ID NO: 822118 - protein, 481 aa, Homo sapiens; identical to SEQ ID NO: 822114

SEQ ID NO: 822119 - protein, 481 aa, Homo sapiens; identical to SEQ ID NO: 822114

SEQ ID NO: 822120 - protein, 476 aa, Homo sapiens
RQPDPAPPAPRSTPEAPAAPASAPLPPPPGAMGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSSLLLATVLPFLSLALGVAEGAD

SEQ ID NO: 822121 - protein, 622 aa, Homo sapiens
RQPDPAPPAPRSTPEAPAAPASAPLPPPPGAMGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKVVTHRCLIKCYEEGTMIIPPNRLEDEEQIEGPSQGHTASQPVHTEERGTFRRAPPSAPHSQAVAQFCPFCFGMSSSIYSQCPMPLPQLRPRSLPCRRKHGPLPIHPPMDPRIGLPDSANSKPLCYKYARCNAGEILILENYVLGIRYSNVTGSPEFDLATLPKRDLSTPSHGSELSLVWLRQTPSVAPTASHPSGTGIPKREWGVSTEAMLRIADY

SEQ ID NO: 822122 - protein, 527 aa, Homo sapiens
RQPDPAPPAPRSTPEAPAAPASAPLPPPPGAMGAPPGYRPSAWVHLLHQLPRADFQLRPVPSVFAPQEQEYQQSLAVTQRPPPTTPLHRLRPRPRLTPALARRPPEAARGDPRPQSPPEALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 822123 - protein, 444 aa, Homo sapiens
SAARPRAARAPLDSGGSRSPGVRPAAPSPGGHGGAPGLPALSLGASPPPAAPRRLPAPPGAQRFRAPRAGIPAGLVAGGGLGGPGLGPEPHFHRCLPHPLLLLPAPRAPRVQDPLARGRLRHLELHCRPSRRLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 822124 - protein, 238 aa, Homo sapiens [sequence omitted]

SEQ ID NO: 822125 - protein, 196 aa, Homo sapiens
FVRLWAPWPGGSHAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 822126 - protein, 83 aa, Homo sapiens
MIPPGERMPGAQPLQMFVELGKALAAMLVSMHGAQLVTTLFLPRGATVVELFPYAVNPDHYTVRSTWPGRPNPGRPTQVPLHI

SEQ ID NO: 822127 - protein, 580 aa, Homo sapiens
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTPYKTLAMLPGMDLQYVAWRNMMPENTVTHPERPWDQGGITHLDRAEQARILQSREVPRHLCCRNPEWLFRIYQDTKVDIPSLIQTIRRVVKGRPGPRKQKWTVGLYPGKVREARCQASVHGASEARLTVSWQIPWNLKYLKVREVKYEVWLQEQGENTYVPYILALQNHTFTENIKPFTTYLVWVRCIFNKILLGPFADVLVCNT

SEQ ID NO: 822128 - protein, 376 aa, Homo sapiens
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTA

SEQ ID NO: 822129 - protein, 148 aa, Homo sapiens
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 822130 - protein, 148 aa, Homo sapiens; identical to SEQ ID NO: 822129

SEQ ID NO: 822131 - protein, 139 aa, Homo sapiens
MLLFFTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 822132 - protein, 148 aa, Homo sapiens; identical to SEQ ID NO: 822129

SEQ ID NO: 822133 - protein, 162 aa, Homo sapiens
AAAYYYYYYKFPAARPSVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 822134 - protein, 148 aa, Homo sapiens; identical to SEQ ID NO: 822129

SEQ ID NO: 822135 - protein, 148 aa, Homo sapiens; identical to SEQ ID NO: 822129

SEQ ID NO: 822136 - protein, 77 aa, Homo sapiens
VEVAVSQDHTTALQARQKTEFFETLSQKKYIYKYTVSDRKHGVGGVGAEDPDSRYILAKPHSGYSSCCQIRIQEVGW

SEQ ID NO: 822137 - protein, 366 aa, Homo sapiens
FPSPCFVFAFLSTYSYLCLSLCLPLRLFSLRAPFFPRPFQIANMAPERLRSRALSAFKLRGLLLRGEAIKYLTEALQSISELELEDKLEKIINAVEKQPLSSNMIERSVVEAAVQECSQSVDETIEHVFNIIGAFDIPRFVYNSERKKFLPLLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGLFTSTSNLLYSVW

SEQ ID NO: 822138 - protein, 366 aa, Homo sapiens; identical to SEQ ID NO: 822137

SEQ ID NO: 822139 - protein, 366 aa, Homo sapiens; identical to SEQ ID NO: 822137

SEQ ID NO: 822140 - protein, 366 aa, Homo sapiens; identical to SEQ ID NO: 822137

SEQ ID NO: 822141 - protein, 366 aa, Homo sapiens; identical to SEQ ID NO: 822137

SEQ ID NO: 822142 - protein, 366 aa, Homo sapiens; identical to SEQ ID NO: 822137

SEQ ID NO: 822143 - protein, 366 aa, Homo sapiens; identical to SEQ ID NO: 822137

SEQ ID NO: 822144 - protein, 366 aa, Homo sapiens; identical to SEQ ID NO: 822137

SEQ ID NO: 822145 - protein, 139 aa, Homo sapiens
FPSPCFVFAFLSTYSYLCLSLCLPLRLFSLRAPFFPRPFQIANMAPERLRSRALSAFKLRGLLLRGEAIKYLTEALQSISELELEDKLEKIINAVEKQPLSSNMIERSVVEAAVQECSQSVDETMYVGTVNFFPPWRCY

SEQ ID NO: 822146 - protein, 1677 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 822147 - protein, 121 aa, Homo sapiens [sequence omitted]

SEQ ID NO: 822148 - protein, 1585 aa, Homo sapiens
MEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 822149 - protein, 1054 aa, Homo sapiens
GDTSSSESGMLSNGERFSESALSKISVRAVSSDTSFWSSRDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 822150 - protein, 1677 aa, Homo sapiens; identical to SEQ ID NO: 822146

SEQ ID NO: 822151 - protein, 1677 aa, Homo sapiens; identical to SEQ ID NO: 822146

SEQ ID NO: 822152 - protein, 1268 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEGPAVVPLDVLEDALPLLRHHLPLRLPHPHHPVLEAAHDPHPPAGEVTGGGGTALIVHMTITKGKECYKRSVQ

SEQ ID NO: 822153 - protein, 1413 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 822154 - protein, 1663 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLGEWREGLKLWNASSPPQKGS

SEQ ID NO: 822155 - protein, 1673 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDVRSRQYSISAPMENLCDLSLIEITERLRY

SEQ ID NO: 822156 - protein, 1680 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIGRNEVRSYHLRGKDKGPKIHSHPHPQQTKKHHGTLNKTEITETTEKKFIINSSEIHSQGEKKRWGFPKALWCEVKKMTDQGRFSLLDEVHHGRRKSCIPKKGIQGKSKTRKRKSSGKSEALSDHYEAE

SEQ ID NO: 822157 - protein, 247 aa, Homo sapiens
MKIVLLDLFYSALSLVLSFLKERQDWGLGEISRVYLNHSQHSCMPSYPSRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 822158 - protein, 159 aa, Homo sapiens
MFGGLMTPSFVRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 822159 - protein, 1216 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSG

SEQ ID NO: 822160 - protein, 1216 aa, Homo sapiens; identical to SEQ ID NO: 822159

SEQ ID NO: 822161 - protein, 1210 aa, Homo sapiens
ASDQSSAGCSGAKMAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEGEGTWVVLLQLFFW

SEQ ID NO: 822162 - protein, 266 aa, Homo sapiens
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCPPCNDTPEGGFLPFRKDGLGHENGCARSTHCIYLRLRGGKLPEIVGIVRPRLPLQNQVHVRRALILPVENFPCRGLPRVVSPRDVTEPLGWCPP

SEQ ID NO: 822163 - protein, 223 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQTEKRRPSSLLRATPRQLS

SEQ ID NO: 822164 - protein, 223 aa, Homo sapiens; identical to SEQ ID NO: 822163

SEQ ID NO: 822165 - protein, 195 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLENLPPESQRRVEQQCQKRGGNWGES

SEQ ID NO: 822166 - protein, 198 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLGKILRETEEGKGLQFSFRCLAPFLGRRY

SEQ ID NO: 822167 - protein, 107 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKGADWATAPMILNTAFLLLPPQKSL

SEQ ID NO: 822168 - protein, 223 aa, Homo sapiens; identical to SEQ ID NO: 822163

SEQ ID NO: 822169 - protein, 223 aa, Homo sapiens; identical to SEQ ID NO: 822163

SEQ ID NO: 822170 - protein, 223 aa, Homo sapiens; identical to SEQ ID NO: 822163

SEQ ID NO: 822171 - protein, 223 aa, Homo sapiens; identical to SEQ ID NO: 822163

SEQ ID NO: 822172 - protein, 223 aa, Homo sapiens; identical to SEQ ID NO: 822163

SEQ ID NO: 822173 - protein, 223 aa, Homo sapiens; identical to SEQ ID NO: 822163

SEQ ID NO: 822174 - protein, 223 aa, Homo sapiens; identical to SEQ ID NO: 822163

SEQ ID NO: 822175 - protein, 223 aa, Homo sapiens; identical to SEQ ID NO: 822163

SEQ ID NO: 822176 - protein, 223 aa, Homo sapiens; identical to SEQ ID NO: 822163

SEQ ID NO: 822177 - protein, 201 aa, Homo sapiens
SEGYSGEVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQTEKRRPSSLLRATPRQLS

SEQ ID NO: 822178 - protein, 240 aa, Homo sapiens
MWELQHCRTLGKFVQGHPAEQRLNQDTIRHAFLVSTTPSTHSPRRPLDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQTEKRRPSSLLRATPRQLS

SEQ ID NO: 822179 - protein, 178 aa, Homo sapiens
KGGTIRLGTRPGGGSRQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQTEKRRPSSLLRATPRQLS

SEQ ID NO: 822180 - protein, 131 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVV

SEQ ID NO: 822181 - protein, 111 aa, Homo sapiens [sequence omitted]

SEQ ID NO: 822182 - protein, 116 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKALTLSEHHLPASGAVRAPPAAPVRAHPACTSAG

SEQ ID NO: 822183 - protein, 223 aa, Homo sapiens; identical to SEQ ID NO: 822163

SEQ ID NO: 822184 - protein, 290 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLEPSGEGSSHRRGGKSTSGGPRGNPRGPDYAAGPPLRHWNTGALTLSLSGTSGTDDDLQLHAHARACSSSTLTRESSNRNTYRTDNTSHSGVSSPQGHAASALPTITNAPNEPRRGCP

SEQ ID NO: 822185 - protein, 168 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQTVNITLRILGTAARGTASGGSRGGHPGYRLYLAVVSSDFAASGPPSWARDSKVTGMVISLDCVASLGIGGSTVSVPSGDREE

SEQ ID NO: 822186 - protein, 116 aa, Homo sapiens; identical to SEQ ID NO: 822182

SEQ ID NO: 822187 - protein, 222 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKKGLKQTRKKAGQSISWLEGA

SEQ ID NO: 822188 - protein, 223 aa, Homo sapiens; identical to SEQ ID NO: 822163

SEQ ID NO: 822189 - protein, 290 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLEPSGEGSSHRRGGKSTSGGPRGNPRGPDYAAGPPLRHWNTGALTLSLSGTSGTDDDLQLHAHARACSSSTLTRESSNRNTYRTDNTSHSGVSSPQGHGASALPTITNAPNEPRRGCP

SEQ ID NO: 822190 - protein, 223 aa, Homo sapiens; identical to SEQ ID NO: 822163

SEQ ID NO: 822191 - protein, 223 aa, Homo sapiens; identical to SEQ ID NO: 822163

SEQ ID NO: 822192 - protein, 223 aa, Homo sapiens; identical to SEQ ID NO: 822163

SEQ ID NO: 822193 - protein, 223 aa, Homo sapiens; identical to SEQ ID NO: 822163

SEQ ID NO: 822194 - protein, 223 aa, Homo sapiens; identical to SEQ ID NO: 822163

SEQ ID NO: 822195 - protein, 223 aa, Homo sapiens; identical to SEQ ID NO: 822163

SEQ ID NO: 822196 - protein, 223 aa, Homo sapiens; identical to SEQ ID NO: 822163

SEQ ID NO: 822197 - protein, 223 aa, Homo sapiens; identical to SEQ ID NO: 822163

SEQ ID NO: 822198 - protein, 207 aa, Homo sapiens
MAAKVFESIGKFGLALAVAGGVVNSALYNVDAGHRAVIFDRFRGVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQTEKRRPSSLLRATPRQLS

SEQ ID NO: 822199 - protein, 111 aa, Homo sapiens [sequence omitted]

SEQ ID NO: 822200 - protein, 111 aa, Homo sapiens [sequence omitted]

SEQ ID NO: 822201 - protein, 116 aa, Homo sapiens; identical to SEQ ID NO: 822182

SEQ ID NO: 822202 - protein, 186 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTQPSFCSHPRNHCEIS

SEQ ID NO: 822203 - protein, 126 aa, Homo sapiens
DDGDRCCRGRYGTQAVAKGIARLFPDHFLLSLREVRAPARPLQNFGALARRRRQDFSRDFCNCVRARWRWVSLGRGGRGTSTAAAHVTGLHSCGVWLRPRPGRGRGQGLGGGDCGAVGVGGLKRKR

SEQ ID NO: 822204 - protein, 178 aa, Homo sapiens
MAAGTAAALAFLSQESRTRAGGVGGLRVPAPVTMDSFFFGCELSGHTRSFTFKVEEEDDAEHVLALTMLCLTEGAKDECNVVEVVARNHDHQEIAVPVANLKLSCQPMLSLDDFQLQPPVTFRLKSGSGPVRITGRHQIVTMSNDVSEEESEEEEEDSDEEEVELCPILPAKKQGGRP

SEQ ID NO: 822205 - protein, 178 aa, Homo sapiens; identical to SEQ ID NO: 822204

SEQ ID NO: 822206 - protein, 178 aa, Homo sapiens; identical to SEQ ID NO: 822204

SEQ ID NO: 822207 - protein, 655 aa, Homo sapiens
NSGRSGRRLLPAGAPSMVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSANLKPSELKKDTCYSPKPSVYLSTPSSASKANTTAFLTPLEIKAKVETDDVKKNSLDELRAQIIELLCIVEALKKDHGKELEKLRKDLEEEKTMRSNLEMEIEKLKKAVLSS

SEQ ID NO: 822208 - protein, 315 aa, Homo sapiens
FERGTPFGVFAPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSANLKPSELKKDTCYSPKPSVYLSTPSSASKANTTAFLTPLEIKAKVETDDVKKNSLDELRAQIIELLCIVEALKKDHGKELEKLRKDLEEEKTMRSNLEMEIEKLKKAVLSS

SEQ ID NO: 822209 - protein, 655 aa, Homo sapiens; identical to SEQ ID NO: 822207

SEQ ID NO: 822210 - protein, 403 aa, Homo sapiens
NSGRSGRRLLPAGAPSMVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKGEANFQLSKKQLFLLLSF

SEQ ID NO: 822211 - protein, 568 aa, Homo sapiens
NSGRSGRRLLPAGAPSMVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSASASRAALKRLVERRGRMEATLRPA

SEQ ID NO: 822212 - protein, 498 aa, Homo sapiens
NSGRSGRRLLPAGAPSMVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETGKSAWTAVVH

SEQ ID NO: 822213 - protein, 709 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 822214 - protein, 660 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 822215 - protein, 653 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 822216 - protein, 607 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRSKDLKKPGARKQ

SEQ ID NO: 822217 - protein, 415 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPVRPQWVEG

SEQ ID NO: 822218 - protein, 319 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLR

SEQ ID NO: 822219 - protein, 134 aa, Homo sapiens
VNCVLKRAYTLVVLIICQFDVGTDLLHVLNKCSMLTPTLEWEYHSVILNWLLGITTLLLTGNATVVTTCAAGPSWFPDLCFLFCLDPDSQKPVTGLLIHILTLVHCDPQTLNYAPPGRATAPLVHLICPHPRIS

SEQ ID NO: 822220 - protein, 155 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQRYWVGSGQSQEWGRA

SEQ ID NO: 822221 - protein, 709 aa, Homo sapiens; identical to SEQ ID NO: 822213

SEQ ID NO: 822222 - protein, 653 aa, Homo sapiens; identical to SEQ ID NO: 822215

SEQ ID NO: 822223 - protein, 607 aa, Homo sapiens; identical to SEQ ID NO: 822216

SEQ ID NO: 822224 - protein, 727 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVRRFSAWVAPASGIPPSGCPGPKTLKNLELESSRLEASTDCRIQGDICRLAL

SEQ ID NO: 822225 - protein, 745 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERVSWASGKSPRLTSAPGPHGLGPMLHASAAHLPPAKQSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 822226 - protein, 663 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRSKDLKKPGARKQ

SEQ ID NO: 822227 - protein, 690 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPSLQGRHSGREDGCKVWETEDTVEPTSTSWNPRGWPGTHVSLSPPPASMMWVSCRRSWCPSSQS

SEQ ID NO: 822228 - protein, 678 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRHLAHRLRRRHQRCQRRTPLAVAPPTGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 822229 - protein, 478 aa, Homo sapiens
MRPRLTLTQPQLHSLLLGAVRTVESASQGMAPKGSGSKRCAKTVERVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 822230 - protein, 709 aa, Homo sapiens; identical to SEQ ID NO: 822213

SEQ ID NO: 822231 - protein, 709 aa, Homo sapiens; identical to SEQ ID NO: 822213

SEQ ID NO: 822232 - protein, 759 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPSLQGRHSGREDGCKVWETEDTVEPTSTSWNPRGWPGTHVSLSPPPASMMWVSCRRSWCPSSQS

SEQ ID NO: 822233 - protein, 709 aa, Homo sapiens; identical to SEQ ID NO: 822213

SEQ ID NO: 822234 - protein, 721 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRYYHLALDWKCNCGYHLCCRSVLVP

SEQ ID NO: 822235 - protein, 619 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPERGGAAERGGAAERGGA

SEQ ID NO: 822236 - protein, 313 aa, Homo sapiens
RCGAPARRRGSLPIKGTRHRGNSAQVLSQRRSPRGRQRTSGSGSNEQPRRRQLPLQRRRPRRRRKGRRARREVQEGPSPWVHGPRVAEDTGLVPNWLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKVSTTCFLFTTLQWEQDVMELVESEGMMMGPQDEESFY

SEQ ID NO: 822237 - protein, 385 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGKKSKRSMNDPY

SEQ ID NO: 822238 - protein, 385 aa, Homo sapiens; identical to SEQ ID NO: 822237

SEQ ID NO: 822239 - protein, 385 aa, Homo sapiens; identical to SEQ ID NO: 822237

SEQ ID NO: 822240 - protein, 332 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQSE

SEQ ID NO: 822241 - protein, 369 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLHQHGDGIL

SEQ ID NO: 822242 - protein, 313 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLSAPDLGIMNCSHPLASFSFTSACTFICSEGTELIGKKKTICESSGIWSNPSPICQKLDKSFSMIKEGDYNPLFIPVAVMVTAFSGLHQHGDGILYVEDTA

SEQ ID NO: 822243 - protein, 103 aa, Homo sapiens [sequence omitted]

SEQ ID NO: 822244 - protein, 103 aa, Homo sapiens [sequence omitted]

SEQ ID NO: 822245 - protein, 143 aa, Homo sapiens [sequence omitted]

SEQ ID NO: 822246 - protein, 103 aa, Homo sapiens [sequence omitted]

SEQ ID NO: 822247 - protein, 103 aa, Homo sapiens [sequence omitted]

SEQ ID NO: 822248 - protein, 120 aa, Homo sapiens
MRLRFDEESSGWSAAAGSCSAPLRGRRRRQRPRDLERPGRRGWPGPAWRPGATLRGLQGPSWGGRRGPEDGWLWDFYFAFSSLCRLSEGRELWRQPRGGETSSGVGRAGFSSGPSHQLAE

SEQ ID NO: 822249 - protein, 120 aa, Homo sapiens; identical to SEQ ID NO: 822248

SEQ ID NO: 822250 - protein, 120 aa, Homo sapiens; identical to SEQ ID NO: 822248

SEQ ID NO: 822251 - protein, 120 aa, Homo sapiens; identical to SEQ ID NO: 822248

SEQ ID NO: 822252 - protein, 503 aa, Homo sapiens
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 822253 - protein, 546 aa, Homo sapiens
EAASLPPLQKKLCDFLWAGGSHGQRLSHFMALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 822254 - protein, 207 aa, Homo sapiens
MTLGSPRKGLLMLLMALVTQGDPVKPSRAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 822255 - protein, 537 aa, Homo sapiens
EAASLPPLQKKLCDFLWAGGSHGQRLSHFMALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVRPLLGLGWRGVVAHGWDFWAQELVSEASASSHRY

SEQ ID NO: 822256 - protein, 537 aa, Homo sapiens; identical to SEQ ID NO: 822255

SEQ ID NO: 822257 - protein, 270 aa, Homo sapiens
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVFAPRTRTNNLRALFRPSRTIG

SEQ ID NO: 822258 - protein, 224 aa, Homo sapiens
MPALPTHISLGSWEPREHYTSKEYLGPWFSLWPLPSSPSPCTSPSAFPSLSHCFSQSPPCLPPGSQVWERGRSDRPHPHSLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVRPLLGLGWRGVVAHGWDFWAQELVSEASASSHRY

SEQ ID NO: 822259 - protein, 75 aa, Homo sapiens
AGTTVAELPVCLPGDPVKPSRGPLVTCTCESPHCKGPTCRGAWCTVVLVREEGRHPQEHRGCGNLHRELCRGRPT

SEQ ID NO: 822260 - protein, 548 aa, Homo sapiens
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSAGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 822261 - protein, 534 aa, Homo sapiens
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 822262 - protein, 548 aa, Homo sapiens; identical to SEQ ID NO: 822260

SEQ ID NO: 822263 - protein, 277 aa, Homo sapiens
LQASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGETANKPQNSVPEQPLPVNCVSELRKRSPSIVASNQGRVLQKAKEWEMKKT

SEQ ID NO: 822264 - protein, 277 aa, Homo sapiens; identical to SEQ ID NO: 822263

SEQ ID NO: 822265 - protein, 277 aa, Homo sapiens; identical to SEQ ID NO: 822263

SEQ ID NO: 822266 - protein, 277 aa, Homo sapiens; identical to SEQ ID NO: 822263

SEQ ID NO: 822267 - protein, 505 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 822268 - protein, 329 aa, Homo sapiens
MSTAYFVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 822269 - protein, 447 aa, Homo sapiens
MYCAWMWPDQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 822270 - protein, 447 aa, Homo sapiens; identical to SEQ ID NO: 822269

SEQ ID NO: 822271 - protein, 455 aa, Homo sapiens
MTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 822272 - protein, 413 aa, Homo sapiens
SSVPDLDSEDDIKEMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 822273 - protein, 395 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQ

SEQ ID NO: 822274 - protein, 144 aa, Homo sapiens
MKFKLHVNSARQYKDLWNMSDDKPFLCTAPGCGQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 822275 - protein, 505 aa, Homo sapiens; identical to SEQ ID NO: 822267

SEQ ID NO: 822276 - protein, 432 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHSE

SEQ ID NO: 822277 - protein, 340 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 822278 - protein, 340 aa, Homo sapiens; identical to SEQ ID NO: 822277

SEQ ID NO: 822279 - protein, 191 aa, Homo sapiens
MPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 822280 - protein, 107 aa, Homo sapiens
MESCSVAQAGVQWRDLGSLQPPLPEFKQFTCLSLLSSWDYRRTPPCPANFVFLVETGFHHVAQAGPELLTSGDPPTSASQSAGITGVSHHTWPTPFFISFLMHIPCC

SEQ ID NO: 822281 - protein, 340 aa, Homo sapiens; identical to SEQ ID NO: 822277

SEQ ID NO: 822282 - protein, 340 aa, Homo sapiens; identical to SEQ ID NO: 822277

SEQ ID NO: 822283 - protein, 340 aa, Homo sapiens; identical to SEQ ID NO: 822277

SEQ ID NO: 822284 - protein, 404 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKGISLCNEEKLKNTLCPSLFLCFWLLKIRDYFNLKKHTNLPCSVCPFKVMWKHKTNVFYVEQNILCAFSFCGSMGNYGLFFK

SEQ ID NO: 822285 - protein, 340 aa, Homo sapiens; identical to SEQ ID NO: 822277

SEQ ID NO: 822286 - protein, 340 aa, Homo sapiens; identical to SEQ ID NO: 822277

SEQ ID NO: 822287 - protein, 191 aa, Homo sapiens; identical to SEQ ID NO: 822279

SEQ ID NO: 822288 - protein, 380 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQVSSSHFNSKVWKVFIERIRCIVTNSKLYACSYYNHWTQLNETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 822289 - protein, 322 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 822290 - protein, 340 aa, Homo sapiens; identical to SEQ ID NO: 822277

SEQ ID NO: 822291 - protein, 1204 aa, Homo sapiens
MVKCYHKKYRSATRDVIFRLQFHTGAVQGYGLVFGKEDLDNASKDDFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 822292 - protein, 1111 aa, Homo sapiens
SPVFSPAVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 822293 - protein, 144 aa, Homo sapiens [sequence omitted]

SEQ ID NO: 822294 - protein, 1204 aa, Homo sapiens; identical to SEQ ID NO: 822291

SEQ ID NO: 822295 - protein, 1204 aa, Homo sapiens; identical to SEQ ID NO: 822291

SEQ ID NO: 822296 - protein, 1204 aa, Homo sapiens; identical to SEQ ID NO: 822291

SEQ ID NO: 822297 - protein, 1204 aa, Homo sapiens; identical to SEQ ID NO: 822291

SEQ ID NO: 822298 - protein, 173 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKM

SEQ ID NO: 822299 - protein, 168 aa, Homo sapiens
GGDLCTWRMLNSTTRFKGRNDLMEYAKQHGIPIPVTPKNPWSMDENLMHITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSAR

SEQ ID NO: 822300 - protein, 131 aa, Homo sapiens
MVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEGACVHLVCSYGGKGHREDSPLKYLKYFAVC

SEQ ID NO: 822301 - protein, 77 aa, Homo sapiens
RLILELDPTFEPIPTHMNALGSQANGSVSPDSVGGGLRASSRLPDTGEGPSRATGRQGELGLHGRCSTGGAPREANV

SEQ ID NO: 822302 - protein, 186 aa, Homo sapiens
MTWRARDDATRGAVHAGIFKSPPRRGAAMSPAAAAAGAGERRRPIASVRDGRGRGCGGPAGAALLGLSLVGLLLYLVPAAAALAWLAVGTTAAWWGLSREPRGSRPLSSFVQKARHRRTLFASPPAKSTANGNLLEPRTLLEGPDPAELLLMGSYLGKPGPPQPAPAPEGQDLRNRPGGGHPPARR

SEQ ID NO: 822303 - protein, 106 aa, Homo sapiens
MAQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 822304 - protein, 106 aa, Homo sapiens; identical to SEQ ID NO: 822303

SEQ ID NO: 822305 - protein, 106 aa, Homo sapiens; identical to SEQ ID NO: 822303

SEQ ID NO: 822306 - protein, 106 aa, Homo sapiens; identical to SEQ ID NO: 822303

SEQ ID NO: 822307 - protein, 106 aa, Homo sapiens; identical to SEQ ID NO: 822303

SEQ ID NO: 822308 - protein, 106 aa, Homo sapiens; identical to SEQ ID NO: 822303

SEQ ID NO: 822309 - protein, 106 aa, Homo sapiens; identical to SEQ ID NO: 822303

SEQ ID NO: 822310 - protein, 106 aa, Homo sapiens; identical to SEQ ID NO: 822303

SEQ ID NO: 822311 - protein, 106 aa, Homo sapiens; identical to SEQ ID NO: 822303

SEQ ID NO: 822312 - protein, 218 aa, Homo sapiens
GVYRGASLASNSLCLHEHVASPSLPRWRTQGPRDTWGVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQCHHPRQAFPDPSQEQTRDQVHTLLRAVSCASPAPSPVFVLCLPGSGRGACPCFFSDREINAPE

SEQ ID NO: 822313 - protein, 1968 aa, Homo sapiens
EFRGRRSGISWLLLSSALILQVGLSADTMSSDTEMEVFGIAAPFLRKSEKERIEAQNQPFDAKTYCFVVDSKEEYAKGKIKSSQDGKVTVETEDNRTLVVKPEDVYAMNPPKFDRIEDMAMLTHLNEPAVLYNLKDRYTSWMIYTYSGLFCVTVNPYKWLPVYNPEVVEGYRGKKRQEAPPHIFSISDNAYQFMLTDRENQSILITGESGAGKTVNTKRVIQYFATIAATGDLAKKKDSKMKGTLEDQIISANPLLEAFGNAKTVRNDNSSRFGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 822314 - protein, 1716 aa, Homo sapiens
MNRNYWAMVESGPPPESRPIQGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 822315 - protein, 1693 aa, Homo sapiens
MPQIIIEEGIIPTSADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 822316 - protein, 1687 aa, Homo sapiens
MNRNYWAMVESGPPPESRPIQGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEAVSEIGADCGRQTVLFPVVSSERGAC

SEQ ID NO: 822317 - protein, 1670 aa, Homo sapiens
MNRNYWAMVESGPPPESRPIQGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQCHHPRQAFPDPSQEQTRDQVHTLLRAVSCASPAPSPVFVLCLPGSGRGACPCFFSDREINAPE

SEQ ID NO: 822318 - protein, 1236 aa, Homo sapiens
MNRNYWAMVESGPPPESRPIQGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKMVVHESEE

SEQ ID NO: 822319 - protein, 699 aa, Homo sapiens
MNRNYWAMVESGPPPESRPIQGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAETGNLLDAEVAVSRDRATALQSGPQSKTL

SEQ ID NO: 822320 - protein, 365 aa, Homo sapiens
MNRNYWAMVESGPPPESRPIQGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRPALLEQDRRYAKCIFS

SEQ ID NO: 822321 - protein, 78 aa, Homo sapiens
MFKWMETEITAASLSYSLRKKLAQRLQDSEEQVEAVNAKCASLEKTKQRLQGEVEDLMVDVERANSLAAALDKKQRNF

SEQ ID NO: 822322 - protein, 75 aa, Homo sapiens
MFVLEQEEYKKEGIEWTFIDFGMDLAACIELIEKVSSSIPTVSSSHRLFCSLLQLIFTSLHFALPSIQPMGIFSI

SEQ ID NO: 822323 - protein, 115 aa, Homo sapiens
EERKKERTKERKERKKERKKECMSVSVCAWKLGHWASDSLPTQERKDPSPPPLARQFTLPTCHVFAKTKILKEMSGQRQGPQAMWPAQPQCHLAAGWGGGGQQHPSLEMLHFPSL

SEQ ID NO: 822324 - protein, 568 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822325 - protein, 612 aa, Homo sapiens
MGQAGRARHARRECSWSTGSIWSGWEWAQEQRRGSTGLFPGAAHLVSWFLQALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822326 - protein, 586 aa, Homo sapiens [sequence omitted]

SEQ ID NO: 822327 - protein, 579 aa, Homo sapiens [sequence omitted]

SEQ ID NO: 822328 - protein, 669 aa, Homo sapiens
RWSSSERCWPGAFSGLCVWVRGTLDGHSALSVWVPRSAGLGGTEGQKVPFGALDSLADSYPTPAWGFREGVQAGVSSFLNGDVASVSVPGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822329 - protein, 417 aa, Homo sapiens
SQRPGPAPIVSAPSSGDPLACAPLGPSTSQACREGERKRLTHWPGPPGAGEAGEAGAGSDLNPEALGGRAQATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822330 - protein, 329 aa, Homo sapiens
SQRPGPAPIVSAPSSGDPLACAPLGPSTSQACREGERKRLTHWPGPPGAGEAGEAGAGSDLNPEALGGRAQATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSCPSWSRKCLYLSHPQTARPDAGTGWNEGGVFISLPSPSHATPAPTGLQVLLMRWDLIEDKKEGEMTPTPSSPSFEKV

SEQ ID NO: 822331 - protein, 568 aa, Homo sapiens; identical to SEQ ID NO: 822324

SEQ ID NO: 822332 - protein, 111 aa, Homo sapiens
MGNVTNKYPRKTLKSPCDAPPALVLGCRPRVSLLVRHPFTTAVNWEETIPMHCSKSRWIWFWGCWAAAQETGRGGRCVAPEGFQSTLCCEDPTPCAPRKWPVFFCSSREPR

SEQ ID NO: 822333 - protein, 254 aa, Homo sapiens
RVAAPWRPSRAFRLLLRRACRWAPLSLPAPSSCSPRPAPLEQFPTEPPFPGSRGPSLPLPRALGGSLFRDHKAPLILCSALSHVTRWAGSARWRVQRSPTFRCWATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENWTRHRALRDPLDQPCD

SEQ ID NO: 822334 - protein, 191 aa, Homo sapiens
RVAAPWRPSRAFRLLLRRACRWAPLSLPAPSSCSPRPAPLEQFPTEPPFPGSRGPSLPLPRALGGSLFRDHKAPLILCSALSHVTRWAGSARWRVQRSPTFRCWGESCSFVLPSLAPLARGLSGGAAARRTLMAMVAVPGATLSLGPGPRPAGPSGVPRRGVAGSSISTRGPDFRPQNRRIGLCVVTAISL

SEQ ID NO: 822335 - protein, 238 aa, Homo sapiens
RVAAPWRPSRAFRLLLRRACRWAPLSLPAPSSCSPRPAPLEQFPTEPPFPGSRGPSLPLPRALGGSLFRDHKAPLILCSALSHVTRWAGSARWRVQRSPTFRCWATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNEN

SEQ ID NO: 822336 - protein, 157 aa, Homo sapiens [sequence omitted]

SEQ ID NO: 822337 - protein, 219 aa, Homo sapiens
RVAAPWRPSRAFRLLLRRACRWAPLSLPAPSSCSPRPAPLEQFPTEPPFPGSRGPSLPLPRALGGSLFRDHKAPLILCSALSHVTRWAGSARWRVQRSPTFRCWATEAAPSCVGDMADTPRDAGLKQAPASRNEKAPVDFGYVGIDSILEQMRRKAMKQGFEFNIMVVGESSPCMPLNQCRKPASAPRAAHKPLGLVFPSVKWGSNPDLRRAIVRFGIL

SEQ ID NO: 822338 - protein, 450 aa, Homo sapiens
RVAAPWRPSRAFRLLLRRACRWAPLSLPAPSSCSPRPAPLEQFPTEPPFPGSRGPSLPLPRALGGSLFRDHKAPLILCSALSHVTRWAGSARWRVQRSPTFRCWATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822339 - protein, 413 aa, Homo sapiens
MSDPAVNAQLDGIISDFEMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822340 - protein, 335 aa, Homo sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822341 - protein, 359 aa, Homo sapiens
AGCTGTWSWLWGTATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822342 - protein, 474 aa, Homo sapiens [sequence omitted]

SEQ ID NO: 822343 - protein, 350 aa, Homo sapiens
WGLVVYYCALCFTINMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822344 - protein, 231 aa, Homo sapiens
MKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822345 - protein, 301 aa, Homo sapiens
VIGRCFAVSLSVRDLVMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822346 - protein, 265 aa, Homo sapiens
LLHLLIFSHLMQERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822347 - protein, 259 aa, Homo sapiens
ALEDKIPALGFPSRSRPSRTDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822348 - protein, 568 aa, Homo sapiens; identical to SEQ ID NO: 822324

SEQ ID NO: 822349 - protein, 225 aa, Homo sapiens
EERNNLRLGTRLGVWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822350 - protein, 183 aa, Homo sapiens
MDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822351 - protein, 157 aa, Homo sapiens [sequence omitted]

SEQ ID NO: 822352 - protein, 568 aa, Homo sapiens; identical to SEQ ID NO: 822324

SEQ ID NO: 822353 - protein, 165 aa, Homo sapiens
SGGQLTTPALPLCIGGMSVKEQMETIRHGVHMMVAIPGRLMDLLQKKMVSLDICRYLALDEADRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822354 - protein, 105 aa, Homo sapiens
QAGTRNYGMFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 822355 - protein, 568 aa, Homo sapiens; identical to SEQ ID NO: 822324

SEQ ID NO: 822356 - protein, 568 aa, Homo sapiens; identical to SEQ ID NO: 822324

SEQ ID NO: 822357 - protein, 568 aa, Homo sapiens; identical to SEQ ID NO: 822324

SEQ ID NO: 822358 - protein, 143 aa, Homo sapiens
MTLCPQAWLPEGSEEQLRCADHPSVWGSQCRRPWGGGQASHLQRSPVGCTLPSIPIGPVPWSVSEPRGECSPPGAPGPPARHMVWPSLSPYPCPAPKGRKLQGPLPPTAQPLQAPWQLPLLEQKVPLSQPSADCSARCGDRLE

SEQ ID NO: 822359 - protein, 143 aa, Homo sapiens; identical to SEQ ID NO: 822358

SEQ ID NO: 822360 - protein, 134 aa, Homo sapiens
LARYEAWVLAAHQEHLDPLPATWCGHHSAPTPALLLRVENSRVPCHRLPSHSKPPGSCPSWSRKCLYLSHPQTARPDAGTGWNEGGVFISLPSPSHATPAPTGLQVLLMRWDLIEDKKEGEMTPTPSSPSFEKV

SEQ ID NO: 822361 - protein, 568 aa, Homo sapiens; identical to SEQ ID NO: 822324

SEQ ID NO: 822362 - protein, 568 aa, Homo sapiens; identical to SEQ ID NO: 822324

SEQ ID NO: 822363 - protein, 501 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTPLSPRGDPWGLSLQGTDDQSPFLLPVTCLAPGEKEGPDETPLRCTHHQVHLQAPGWLLAARRRSARRSV

SEQ ID NO: 822364 - protein, 568 aa, Homo sapiens; identical to SEQ ID NO: 822324

SEQ ID NO: 822365 - protein, 568 aa, Homo sapiens; identical to SEQ ID NO: 822324

SEQ ID NO: 822366 - protein, 106 aa, Homo sapiens
GICLDGIKLGERRERASGVHSPQLKSKVSWQHGPAPHPLSPRGDPWGLSLQGTDDQSPFLLPVTCLAPGEKEGPDETPLRCTHHQVHLQAPGWLLAARRRSARRSV

SEQ ID NO: 822367 - protein, 399 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYCLQPGEGQREGVYECECVCMEVGALGV

SEQ ID NO: 822368 - protein, 568 aa, Homo sapiens; identical to SEQ ID NO: 822324

SEQ ID NO: 822369 - protein, 568 aa, Homo sapiens; identical to SEQ ID NO: 822324

SEQ ID NO: 822370 - protein, 568 aa, Homo sapiens; identical to SEQ ID NO: 822324

SEQ ID NO: 822371 - protein, 166 aa, Homo sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYCLQPGEGQREGVYECECVCMEVGALGV

SEQ ID NO: 822372 - protein, 593 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSIPALRCFTFLLCNQTLKNCSFHQALFLNGLLLRASREICLFV

SEQ ID NO: 822373 - protein, 577 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSIPALRCFTFLLCNQTLKNCSFHQALFLNGLLLRASREICLFV

SEQ ID NO: 822374 - protein, 578 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKVPQVGKLTVCSVFNFDG

SEQ ID NO: 822375 - protein, 539 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTRHRALRDPLDQPCD

SEQ ID NO: 822376 - protein, 115 aa, Homo sapiens; identical to SEQ ID NO: 822323

SEQ ID NO: 822377 - protein, 521 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVETRTHCEIHSRRPI

SEQ ID NO: 822378 - protein, 518 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEGTRRRRRGSRQM

SEQ ID NO: 822379 - protein, 435 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPRWRVLLQHHAPLQPAVPCDLCGAVIQGAGEEYLGAKVFYGSEDCARFQD

SEQ ID NO: 822380 - protein, 399 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCIPALRCFTFLLCNQTLKNCSFHQALFLNGLLLRASREICLFV

SEQ ID NO: 822381 - protein, 372 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENWTRHRALRDPLDQPCD

SEQ ID NO: 822382 - protein, 360 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENWCPQ

SEQ ID NO: 822383 - protein, 388 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPILSPGQSGLGKSTLINTLFKSKISRKYV

SEQ ID NO: 822384 - protein, 155 aa, Homo sapiens
YELEVETFCRASGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSIPALRCFTFLLCNQTLKNCSFHQALFLNGLLLRASREICLFV

SEQ ID NO: 822385 - protein, 123 aa, Homo sapiens
RQSLTLLPRLECSGAISAHCNLRLPDSSDSPASASRVAGIIGTHHHTQLIFVFLVETGFHHVGQAGLELLVSSDLPSSASQSAGITGVSHRAWPTLSHFKTLLSATKVACTMGNVTNKYPRKT

SEQ ID NO: 822386 - protein, 420 aa, Homo sapiens
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 822387 - protein, 367 aa, Homo sapiens
MGLVVGAVCSPEESWEKGSQVLKHPTETNTAIQYGLFGCIYHEATRRNSTYEATLKCNRIGYVDDVPLPGIISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 822388 - protein, 448 aa, Homo sapiens
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREVCCHFLDKNPNELTQSDNLSFEFVIPTEISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 822389 - protein, 150 aa, Homo sapiens [sequence omitted]

SEQ ID NO: 822390 - protein, 290 aa, Homo sapiens
RVNKTPTGAALPRGLTGLWRSSLPIRKLQLPPDALKMATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRFVGIS

SEQ ID NO: 822391 - protein, 246 aa, Homo sapiens
RPRPRAPDMLGQPAPLERFASRRPQVLAVRTVCDLVLGKMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 822392 - protein, 246 aa, Homo sapiens; identical to SEQ ID NO: 822391

SEQ ID NO: 822393 - protein, 220 aa, Homo sapiens
PPRPPRRPLVLGKMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 822394 - protein, 107 aa, Homo sapiens
RPRPRAPDMLGQPAPLERFASRRPQVLAVRTVCDLVLGKMDKDCEMKRTTLDSPLGKLELSGCEQGLHEIKLLGKGTSAAEPLLVLPCLGVIIRRMDQPGAIGNALR

SEQ ID NO: 822395 - protein, 71 aa, Homo sapiens
DRIALIAPPTARAALGFLPGCYSGGLAVKEWLLAHEGHRLGKPGLGGSSGLAGAWLKGAGATSGSPPAGRN

SEQ ID NO: 822396 - protein, 103 aa, Homo sapiens [sequence omitted]

SEQ ID NO: 822397 - protein, 564 aa, Homo sapiens
MKEHGGTFSSTGISGGSGDSAMDSLQPLQPNYMPVCLFAEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 822398 - protein, 564 aa, Homo sapiens; identical to SEQ ID NO: 822397

SEQ ID NO: 822399 - protein, 736 aa, Homo sapiens
MKKSRSVMTVMADDNVKDYFECSLSKSYSSSSNTLGIDLWRGRRCCSGNLQLPPLSQRQSERARTPEGDGISRPTTLPLTTLPSIAITTVSQECFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 822400 - protein, 721 aa, Homo sapiens
MTAKDSSKELTASEPEVCIKTFKEQMHLELELPRLPGNRPTSPKISPRSSPRNSPCFFRKLLVNKSIRQRRRFTVAHTCFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 822401 - protein, 736 aa, Homo sapiens; identical to SEQ ID NO: 822399

SEQ ID NO: 822402 - protein, 721 aa, Homo sapiens; identical to SEQ ID NO: 822400

SEQ ID NO: 822403 - protein, 453 aa, Homo sapiens
MKEHGGTFSSTGISGGSGDSAMDSLQPLQPNYMPVCLFAEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVSNMRFSKFL

SEQ ID NO: 822404 - protein, 224 aa, Homo sapiens
MKKSRSVMTVMADDNVKDYFECSLSKSYSSSSNTLGIDLWRGRRCCSGNLQLPPLSQRQSERARTPEGDGISRPTTLPLTTLPSIAITTVSQECFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQGRPCHKVYLDVSR

SEQ ID NO: 822405 - protein, 98 aa, Homo sapiens
GGESWKEGASVQIMKEHGGTFSSTGISGGSGDSAMDSLQPLQPNYMPVCLFAEESYQKLAMETLEELDWCLDQLETIQTYRSVSEMASNKVRDDLFIH

SEQ ID NO: 822406 - protein, 188 aa, Homo sapiens
EEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 822407 - protein, 141 aa, Homo sapiens
GTTAGEAGSFSGAVALAADAGSRTLGVMYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 822408 - protein, 141 aa, Homo sapiens; identical to SEQ ID NO: 822407

SEQ ID NO: 822409 - protein, 97 aa, Homo sapiens
GTTAGEAGSFSGAVALAADAGSRTLGVMYYKFSGFTQKLAGAWASEAYSPQGLKPVVSTEAPPIIFATPTKLTSDSTVYDYAGKNKVPELQKFFQCI

SEQ ID NO: 822410 - protein, 141 aa, Homo sapiens; identical to SEQ ID NO: 822407

SEQ ID NO: 822411 - protein, 141 aa, Homo sapiens; identical to SEQ ID NO: 822407

SEQ ID NO: 822412 - protein, 141 aa, Homo sapiens; identical to SEQ ID NO: 822407

SEQ ID NO: 822413 - protein, 120 aa, Homo sapiens
GPQPGRRGPSLGRSRWQRMREAGLWASCTTSLVASRRSWQEHGLRRPIARRYEWRLASSDMRSGGPSLGDRQSRRWSQGRLLPAVEFVSVLLAPPGASPHQRIKACGFHRSTTYHICHTN

SEQ ID NO: 822414 - protein, 187 aa, Homo sapiens
MKDMPLSGHFSLLLPCEEGHVCFPFCIIDWWPHKKRQEESCLCAHTPRKSHVSTQRKGSRAHKPGREPCTPELNCENIHSCCLSHQSVVFYGSPAKTGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 822415 - protein, 116 aa, Homo sapiens
QGGREMDGNCWGCEKPGALTGVVIDLGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 822416 - protein, 122 aa, Homo sapiens
GTTAGEAGSFSGAVALAADAGSRTLGVMYYKFSGFTQKLAEAPPIIFATPTKLTSDSTVYDYAGKNKVPELQKFFQKADGVPVYLKRGLPDQMLYRTTMALTVGGTIYCLIALYMASQPKNK

SEQ ID NO: 822417 - protein, 141 aa, Homo sapiens; identical to SEQ ID NO: 822407

SEQ ID NO: 822418 - protein, 141 aa, Homo sapiens; identical to SEQ ID NO: 822407

SEQ ID NO: 822419 - protein, 194 aa, Homo sapiens
GTTAGEAGSFSGAVALAADAGSRTLGVMYYKFSGFTQKLAGAWASEAYSPQGLKPVVSTEAPPIIFATPTKLTSDSTVYDYAGKNKVPELQKFFQETYLQTILFLWLLETPVVGILDKGTFGQQGFSDGDTDVRHCCVVDSPRPRLRTKTDTDSLLFPLSPFQSKSVNLPWSFPSMSNECLSPSVVEEVQILKF

SEQ ID NO: 822420 - protein, 502 aa, Homo sapiens
MQSEIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 822421 - protein, 631 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 822422 - protein, 580 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLREIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 822423 - protein, 496 aa, Homo sapiens [sequence omitted]

SEQ ID NO: 822424 - protein, 624 aa, Homo sapiens
CACAERGARGGWAVGCSALGSAATPRSDRSVPRAAVSTRIQAGANESGGIARSGQAHGRLSGTPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 822425 - protein, 496 aa, Homo sapiens [sequence omitted]

SEQ ID NO: 822426 - protein, 496 aa, Homo sapiens [sequence omitted]

SEQ ID NO: 822427 - protein, 631 aa, Homo sapiens; identical to SEQ ID NO: 822421

SEQ ID NO: 822428 - protein, 631 aa, Homo sapiens; identical to SEQ ID NO: 822421

SEQ ID NO: 822429 - protein, 617 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 822430 - protein, 266 aa, Homo sapiens
ALGLVSVFGRGAVPAGGRASGYVFDLCLPFLGPQLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 822431 - protein, 619 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDSEWSWGMDRPAWGLGNRTAGASWRVV

SEQ ID NO: 822432 - protein, 631 aa, Homo sapiens; identical to SEQ ID NO: 822421

SEQ ID NO: 822433 - protein, 152 aa, Homo sapiens [sequence omitted]

SEQ ID NO: 822434 - protein, 631 aa, Homo sapiens; identical to SEQ ID NO: 822421

SEQ ID NO: 822435 - protein, 631 aa, Homo sapiens; identical to SEQ ID NO: 822421

SEQ ID NO: 822436 - protein, 723 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSAICSAFPHRQASFPRGGHRVLSHRPRPQQAAAGGMPHPSQGSPQLHLPCLLSAYLPEPCSPAHLSPAACPNTPPLACQPTHWPVCWVLTKLSSLLHLVCLSLSW

SEQ ID NO: 822437 - protein, 632 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSVAGGQHGRASLPH

SEQ ID NO: 822438 - protein, 631 aa, Homo sapiens; identical to SEQ ID NO: 822421

SEQ ID NO: 822439 - protein, 632 aa, Homo sapiens; identical to SEQ ID NO: 822437

SEQ ID NO: 822440 - protein, 480 aa, Homo sapiens
CACAERGARGGWAVGCSALGSAATPRSDRSVPRAAVSTRIQAGANESGGIARSGQAHGRLSGTPPPPQPPPPPPPPPPQPAAARAQQPWLKTTGTGACGEQEEKEVARPHPGPPPQAPPRRPRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDQPEAVPGMTVGASPTCPTWNCLFQLVRGWLPATGSGTPDSARTVSREGRPRADLRAGSFPKFLGGTWSPAVVGRPPVGGGFKEALPGRPLPGRCSHGAWGL

SEQ ID NO: 822441 - protein, 98 aa, Homo sapiens
MFRGGWGVLWFLTPPGLPYPSPCHQIVHEDLKMGSDGESDQASATSSDEVQSPVRVRMRNHPPRKISTEVLDPVWMVEELEKGVGPGEVELMILFLSC

SEQ ID NO: 822442 - protein, 272 aa, Homo sapiens
AAFPSRAPARRLPPPPPPPELCSMASRRMETKPVITCLKTLLIIYSFVFWITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822443 - protein, 272 aa, Homo sapiens; identical to SEQ ID NO: 822442

SEQ ID NO: 822444 - protein, 272 aa, Homo sapiens; identical to SEQ ID NO: 822442

SEQ ID NO: 822445 - protein, 272 aa, Homo sapiens; identical to SEQ ID NO: 822442

SEQ ID NO: 822446 - protein, 272 aa, Homo sapiens; identical to SEQ ID NO: 822442

SEQ ID NO: 822447 - protein, 272 aa, Homo sapiens; identical to SEQ ID NO: 822442

SEQ ID NO: 822448 - protein, 272 aa, Homo sapiens; identical to SEQ ID NO: 822442

SEQ ID NO: 822449 - protein, 272 aa, Homo sapiens; identical to SEQ ID NO: 822442

SEQ ID NO: 822450 - protein, 272 aa, Homo sapiens; identical to SEQ ID NO: 822442

SEQ ID NO: 822451 - protein, 272 aa, Homo sapiens; identical to SEQ ID NO: 822442

SEQ ID NO: 822452 - protein, 283 aa, Homo sapiens
AAFPSRAPARRLPPPPPPPELCSMASRRMETKPVITCLKTLLIIYSFVFWVYRRGGKNTPGITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822453 - protein, 240 aa, Homo sapiens
LLVLVEHFQNFVRKGTREITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822454 - protein, 163 aa, Homo sapiens
MLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822455 - protein, 258 aa, Homo sapiens
PNPCLKKPFPQKPPPQKPNLPFGPFPGIPGGLNPLGLGWELGGPKLPPGATQKILPPNPEEPPTKLPYCSFIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822456 - protein, 259 aa, Homo sapiens
MASRRMETKPVITCLKTLLIIYSFVFWITGVILLAVGVWGKLTLGTYISLIAENSTNAPYVLIGTGTTIVVFGLFGCFATCRGSPWMLKLYLLLQESIISLYPPTTTTHTPNYTHPPTHPLPHQSNQHITPSSHHTSLHTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822457 - protein, 114 aa, Homo sapiens
ARYRVSTDVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 822458 - protein, 94 aa, Homo sapiens
GTRQMLPMCSSEHGIPPSCCMNETDCNPQDLHNLTVAATKVNQKGCYDLVTSFMETNMGIIAGVAFGIAFSQLIGMLLACCLSRFITANQYEMV

SEQ ID NO: 822459 - protein, 120 aa, Homo sapiens
AAFPSRAPARRLPPPPPPPELCSMASRRMETKPVITCLKTLLIIYSFVFWITGVILLAVGVWGKLTLGTYISLIAENSTNAPYVLIGTGTTIVVFGLFGCFATCRGSPWMLKLRKQNKNQ

SEQ ID NO: 822460 - protein, 105 aa, Homo sapiens [sequence omitted]

SEQ ID NO: 822461 - protein, 113 aa, Homo sapiens
KKKKKKKKKKKKKKFRNAEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 822462 - protein, 142 aa, Homo sapiens
MDGNSMYHAYRVSSYSYRLTAIQFCAIVSVINRAHMTVVLQCFDWDNADRGSGQQSVTGVTSVDDSNSYWRIRGKSATVCERGTPIKCGQPIRLTHVNTGRNLHSHHFTSPLSGNQVRWLSMDCCCSALLSGCLFDLLVLKC

SEQ ID NO: 822463 - protein, 211 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 822464 - protein, 211 aa, Homo sapiens; identical to SEQ ID NO: 822463

SEQ ID NO: 822465 - protein, 211 aa, Homo sapiens; identical to SEQ ID NO: 822463

SEQ ID NO: 822466 - protein, 211 aa, Homo sapiens; identical to SEQ ID NO: 822463

SEQ ID NO: 822467 - protein, 211 aa, Homo sapiens; identical to SEQ ID NO: 822463

SEQ ID NO: 822468 - protein, 123 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQLLCKVIL

SEQ ID NO: 822469 - protein, 211 aa, Homo sapiens; identical to SEQ ID NO: 822463

SEQ ID NO: 822470 - protein, 117 aa, Homo sapiens
NRTLDPSPFPSLSLHIHLLTSDEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 822471 - protein, 147 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQNMVDLSVGKKRCMAWPSQVRTTTGKPWKASS

SEQ ID NO: 822472 - protein, 365 aa, Homo sapiens
VLPNIKSEDTPCLLSIDLFHVLVGAVLAFPSLYWDDPVDLQPSSVSSSYNHLYLFHLITMAHMLQILLTVDTGLPLAQVQEDSEEAHSASSFFAEISQYTSGSIGCDIPGWYLWVSLKNGITPYLRCAALFFHYLLGVTPPEELHTNSAEGEYSALCSYLSLPTNLFLLFQEYWDTVRPLLQRWCADPALLNCLKQKNTVVRYPRKRNSLIELPDDYSCLLNQASHFRCPRSADDERKHPVLCLFCGAILCSQNICCQEIVNGEEVGACIFHALHCGAGVCIFLKIRECRVVLVEGKARGCAYPAPYLDEYGETDPGLKRGNPLHLSRERYRKLHLVWQQHCIIEEIARSQETNQMLFGFNWQLL

SEQ ID NO: 822473 - protein, 365 aa, Homo sapiens; identical to SEQ ID NO: 822472

SEQ ID NO: 822474 - protein, 365 aa, Homo sapiens; identical to SEQ ID NO: 822472

SEQ ID NO: 822475 - protein, 160 aa, Homo sapiens
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 822476 - protein, 160 aa, Homo sapiens; identical to SEQ ID NO: 822475

SEQ ID NO: 822477 - protein, 160 aa, Homo sapiens; identical to SEQ ID NO: 822475

SEQ ID NO: 822478 - protein, 161 aa, Homo sapiens [sequence omitted]

SEQ ID NO: 822479 - protein, 160 aa, Homo sapiens; identical to SEQ ID NO: 822475

SEQ ID NO: 822480 - protein, 160 aa, Homo sapiens; identical to SEQ ID NO: 822475

SEQ ID NO: 822481 - protein, 102 aa, Homo sapiens
LSILDLEADFLPEVKCSSYPAIVSIRGGGEGAALPWTLRHPACPSPSPGLCVMSAAAIYTVRHPEWHLNSDYSYGFAYILAWVAFPLALLSGVIYVILRKRE

SEQ ID NO: 822482 - protein, 86 aa, Homo sapiens
MAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 822483 - protein, 200 aa, Homo sapiens
HEVRHRRTHSGERPYVCEDCGERFRHKVQIRRHERQLHGAGRSRGLGLLRASRPAALGGPARAEQAATATAPADKALGGLGDTAAEAKKLACGVFAEGHIELQVESGVPLGFSTMAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 822484 - protein, 86 aa, Homo sapiens; identical to SEQ ID NO: 822482

SEQ ID NO: 822485 - protein, 86 aa, Homo sapiens; identical to SEQ ID NO: 822482

SEQ ID NO: 822486 - protein, 83 aa, Homo sapiens
MKRTPTFLFDNEGTHRGGYKIKDDQRPPLNSGVSGKNGSGQHGEEQSRGEDVWTNSRRVGPGQYNGTLWCNRESRRKGTMIEI

SEQ ID NO: 822487 - protein, 86 aa, Homo sapiens; identical to SEQ ID NO: 822482

SEQ ID NO: 822488 - protein, 86 aa, Homo sapiens; identical to SEQ ID NO: 822482

SEQ ID NO: 822489 - protein, 86 aa, Homo sapiens; identical to SEQ ID NO: 822482

SEQ ID NO: 822490 - protein, 141 aa, Homo sapiens
MVKGDLVPSDPHPRILNHDLPANKNSLEKKQTKKKKRGGGGAKNSPGGAKLAYPGFLVTKGVPLGEEAIIKKKERGRGLTNRGERGKSRAGQAGGRRPSLLGGRDSLGRHTRGRLKVRAIYPGGLRVYHAYLPEMARIVKL

SEQ ID NO: 822491 - protein, 164 aa, Homo sapiens
MPREGHPRPRATPNFGVTKRGPHKGEGPIYNTDQGARRSTPPQRVARGTTRSSRGTPRGEKAALNTERGEANTPWGTHTPHKRPLRARRDKKHSNAPVQAVVAPHGRHTRDRRYTAFAHRTYMLTPLLTREYNNNKLARHTITAALYPRPSTATHEPLYTVRHL

SEQ ID NO: 822492 - protein, 86 aa, Homo sapiens; identical to SEQ ID NO: 822482

SEQ ID NO: 822493 - protein, 86 aa, Homo sapiens; identical to SEQ ID NO: 822482

SEQ ID NO: 822494 - protein, 86 aa, Homo sapiens; identical to SEQ ID NO: 822482

SEQ ID NO: 822495 - protein, 42 aa, Homo sapiens
MTYLLIKTHWKKKNPNSTLLRGITLKITPIKTQWPSFLNYFT

SEQ ID NO: 822496 - protein, 102 aa, Homo sapiens
NRVVRSPDGVPLGFSTMAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 822497 - protein, 122 aa, Homo sapiens
RVSSPSSLLDVGGAAASSPMHPHPQIPGRDLAGFSTMAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 822498 - protein, 182 aa, Homo sapiens
HEVRHRRTHSGERPYVCEDCGERFRHKVQIRRHERQLHGAGRSRGLGLLRASRPAALGGPARAEQAATATAPADKALGGLGDTAAEAKKLACGVFAEGHIELQVESGVPLGFSTMAEDMETQTRNCWQNYLDFHRCQKAMTAKGGDISVCEWYQRVYQSLCPTSWVTDWDEQRAEGTFPGKI

SEQ ID NO: 822499 - protein, 312 aa, Homo sapiens
HEVRHRRTHSGERPYVCEDCGERFRHKVQIRRHERQLHGAGRSRGLGLLRASRPAALGGPARAEQAATATAPADKALGGLGDTAAEAKKLACGVFAEGHIELQVESGVPLGFSTMAEDMETKIKNYKTAPFDSRFPNQNQQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 822500 - protein, 427 aa, Homo sapiens
HEVRHRRTHSGERPYVCEDCGERFRHKVQIRRHERQLHGAGRSRGLGLLRASRPAALGGPARAEQAATATAPADKALGGLGDTAAEAKKLACGVFAEGHIELQVESGVPLGFSTMAEDMETKIKNYKTAPFDSRFPNQNQTRNCWQNYLDFHRCQKEVTAVVSFLENLLCLQLMELLMFILVRHMPHLSTKVSDSPSHIATTRLSEESARLVAATVTILSDLPSLCSPAGCMTILPTILFLIARILDTAIKSADNQVPPPVSAALQGISIVTLSMAKTEAGVQKQWTALIRSTLACILEYSQPDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGDKQSQLL

SEQ ID NO: 822501 - protein, 318 aa, Homo sapiens
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 822502 - protein, 318 aa, Homo sapiens; identical to SEQ ID NO: 822501

SEQ ID NO: 822503 - protein, 251 aa, Homo sapiens
MELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 822504 - protein, 274 aa, Homo sapiens
YFPENLRPWDWRQLRSSLVVFRVPSNRNERFTSLIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 822505 - protein, 153 aa, Homo sapiens
MSINFSQAEKPEPTNQGQDSLKKHLHAEIKVIGFIISGSLSIATEKRLTKLLVHSSLVGSILSALSALVGFIILSVKQATLNPASLQCGTLSLMLICTLLEFCLAVLTAVLRWKQAYSDFPGSVLFLPHSYIGNSGMSSKMTHDCGYEELLTS

SEQ ID NO: 822506 - protein, 246 aa, Homo sapiens
MVLLTLLEVYSNGSAGTFHKSTIFGNTIMTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAEISLLDGWIWHFWLGILAWLVAPLAGARVGKQGLL

SEQ ID NO: 822507 - protein, 248 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 822508 - protein, 225 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGVSVLAGFT

SEQ ID NO: 822509 - protein, 248 aa, Homo sapiens; identical to SEQ ID NO: 822507

SEQ ID NO: 822510 - protein, 225 aa, Homo sapiens; identical to SEQ ID NO: 822508

SEQ ID NO: 822511 - protein, 225 aa, Homo sapiens; identical to SEQ ID NO: 822508

SEQ ID NO: 822512 - protein, 248 aa, Homo sapiens; identical to SEQ ID NO: 822507

SEQ ID NO: 822513 - protein, 294 aa, Homo sapiens
LGTSSYGLVLFHGLYLGRLYQLYSKDAMCLERFHRIYNLSRLGNTIMTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 822514 - protein, 191 aa, Homo sapiens
MVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 822515 - protein, 103 aa, Homo sapiens
MTSQPVPNETIIVLPSNVINFSQAEKPEPTNQGQDSLKKHLHAEIKVIGIILASASFSPNFTQVTSTLLNSAYPFIGPFFFIISGSLSIATEKRLTKLLGFLS

SEQ ID NO: 822516 - protein, 214 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLALEFCLAVLTAVLRWKQAYSDFPGVSVLAGFT

SEQ ID NO: 822517 - protein, 166 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCIPRTAIQPKPVWLELSL

SEQ ID NO: 822518 - protein, 214 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCGTLSLMLICTLLEFCLAVLTAVLRWKQAYSDFPGSVLFLPHSYIGNSGMSSKMTHDCGYEELLTS

SEQ ID NO: 822519 - protein, 214 aa, Homo sapiens; identical to SEQ ID NO: 822518

SEQ ID NO: 822520 - protein, 218 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAEISLLDGWIWHFWLGILAWLVAPLAGARVGKQGLL

SEQ ID NO: 822521 - protein, 166 aa, Homo sapiens; identical to SEQ ID NO: 822517

SEQ ID NO: 822522 - protein, 161 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATECSVCPGGFHYPVCQTGHLKSCLTAVWNSLSDADLHSAGILPSCAHCCAAVETGLL

SEQ ID NO: 822523 - protein, 120 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLGLMLEIM

SEQ ID NO: 822524 - protein, 120 aa, Homo sapiens; identical to SEQ ID NO: 822523

SEQ ID NO: 822525 - protein, 127 aa, Homo sapiens
MTSQPVPNETIIVLPSNVINFSQAEKPEPTNQGQDSLKKHLHAEIKVIGVHSSLVGSILSALSALVGFIILSVKQATLNPASLQCGTLSLMLICTLLEFCLAVLTAVLRWKQAYSDFPGVSVLAGFT

SEQ ID NO: 822526 - protein, 141 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFVSRVSEEGRMGQRGEEDANSLDFPPASLLCLICQEQGVNGESCSPVG

SEQ ID NO: 822527 - protein, 141 aa, Homo sapiens; identical to SEQ ID NO: 822526

SEQ ID NO: 822528 - protein, 111 aa, Homo sapiens
FLLSFLLLGEVAVHVSFQYLTYSHGAGGRGKRGTIAIFKDALETNREHINTTTSTITCYWPSDTFKRKRQSLFFFLNDIHINSYFYPIIIVFCLYLVLCGKGLHHRFFPAL

SEQ ID NO: 822529 - protein, 111 aa, Homo sapiens; identical to SEQ ID NO: 822528

SEQ ID NO: 822530 - protein, 111 aa, Homo sapiens; identical to SEQ ID NO: 822528

SEQ ID NO: 822531 - protein, 111 aa, Homo sapiens; identical to SEQ ID NO: 822528

SEQ ID NO: 822532 - protein, 111 aa, Homo sapiens; identical to SEQ ID NO: 822528

SEQ ID NO: 822533 - protein, 111 aa, Homo sapiens; identical to SEQ ID NO: 822528

SEQ ID NO: 822534 - protein, 688 aa, Homo sapiens
MATNGSKVADGQISTEVSEAPVANDKPKTLVVKVQKKAADLPDRDTWKGRFDFLMSCVGYAIGLGNVWRFPYLCGKNGGGAFLIPYFLTLIFAGVPLFLLECSLGQYTSIGGLGVWKLAPMFKGVGLAAAVLSFWLNIYYIVIISWAIYYLYNSFTTTLPWKQCDNPWNTDRCFSNYSMVNTTNMTSAVVEFWERNMHQMTDGLDKPGQIRWPLAITLAIAWILVYFCIWKGVGWTGKVVYFSATYPYIMLIILFFRGVTLPGAKEGILFYITPNFRKLSDSEVWLDAATQIFFSYGLGLGSLIALGSYNSFHNNVYRDSIIVCCINSCTSMFAGFVIFSIVGFMAHVTKRSIADVAASGPGLAFLAYPEAVTQLPISPLWAILFFSMLLMLGIDSQFCTVEGFITALVDEYPRLLRNRRELFIAAVCIISYLIGLSNITQGGIYVFKLFDYYSASGMSLLFLVFFECVSISWFYGVNRFYDNIQEMVGSRPCIWWKLCWSFFTPIIVAGVFIFSAVQMTPLTMGNYVFPKWGQGVGWLMALSSMVLIPGYMAYMFLTLKGSLKQRIQVMVQPSEDMFAQRMVLSSPGGQLHQQGGLHLGWGPLTDPTLSPPDLAECDHHLMSEDTFHLNLPRVASPDTITTQRGEVGGQLDPWVGPAVGKDTRWLLAPGGLVTFLIQAPSASHDRPW

SEQ ID NO: 822535 - protein, 688 aa, Homo sapiens; identical to SEQ ID NO: 822534

SEQ ID NO: 822536 - protein, 688 aa, Homo sapiens; identical to SEQ ID NO: 822534

SEQ ID NO: 822537 - protein, 688 aa, Homo sapiens; identical to SEQ ID NO: 822534

SEQ ID NO: 822538 - protein, 688 aa, Homo sapiens; identical to SEQ ID NO: 822534

SEQ ID NO: 822539 - protein, 55 aa, Homo sapiens
MHQMTDGLDKPGQIRWPLAITLAIAWILVYFCIWKGVGWTGKVRDICAQWGQEGT

SEQ ID NO: 822540 - protein, 210 aa, Homo sapiens
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 822541 - protein, 108 aa, Homo sapiens
MSACFLDTRRAAFLQCDLPSSYRILTLPESGHCGSAEPVSDAPALLLSGNSILHSAADSVTSAVQKASQALNERGERLGRAEEKTEDLKNSAQQFAETAHKLAMKHKC

SEQ ID NO: 822542 - protein, 256 aa, Homo sapiens
CFAGARTRRRAGARLQLELQRPELELPGVSPQPLPFRARQQEPAREPRAAASQHPGRLSLVRARSPEPRAGQPPGEEPRALGRVPRTGTAGARARLHVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 822543 - protein, 210 aa, Homo sapiens; identical to SEQ ID NO: 822540

SEQ ID NO: 822544 - protein, 210 aa, Homo sapiens; identical to SEQ ID NO: 822540

SEQ ID NO: 822545 - protein, 318 aa, Homo sapiens
CFAGARTRRRAGARLQLELQRPELELPGVSPQPLPFRARQQEPAREPRAAASQHPGRLSLVRARSPEPRAGQPPGEEPRALGRVPRTGTAGARARLHDSLRAVLTCSTMSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 822546 - protein, 234 aa, Homo sapiens
RQVARLGGEGLNKYSLRAVLTCSTMSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 822547 - protein, 210 aa, Homo sapiens; identical to SEQ ID NO: 822540

SEQ ID NO: 822548 - protein, 222 aa, Homo sapiens
MNSLRAVLTCSTMSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 822549 - protein, 210 aa, Homo sapiens; identical to SEQ ID NO: 822540

SEQ ID NO: 822550 - protein, 318 aa, Homo sapiens; identical to SEQ ID NO: 822545

SEQ ID NO: 822551 - protein, 318 aa, Homo sapiens; identical to SEQ ID NO: 822545

SEQ ID NO: 822552 - protein, 180 aa, Homo sapiens
MNSLRAVLTCSTMSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGTSISLVVTRDARRGTKP

SEQ ID NO: 822553 - protein, 426 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 822554 - protein, 393 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDEGRHGHGKGFLGYGKPKCICSSEEEDLKTN

SEQ ID NO: 822555 - protein, 271 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDQWS

SEQ ID NO: 822556 - protein, 426 aa, Homo sapiens; identical to SEQ ID NO: 822553

SEQ ID NO: 822557 - protein, 426 aa, Homo sapiens; identical to SEQ ID NO: 822553

SEQ ID NO: 822558 - protein, 426 aa, Homo sapiens; identical to SEQ ID NO: 822553

SEQ ID NO: 822559 - protein, 426 aa, Homo sapiens; identical to SEQ ID NO: 822553

SEQ ID NO: 822560 - protein, 426 aa, Homo sapiens; identical to SEQ ID NO: 822553

SEQ ID NO: 822561 - protein, 392 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDESTGCLFPMLILEELTSCKKGILSLHLLF

SEQ ID NO: 822562 - protein, 414 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 822563 - protein, 192 aa, Homo sapiens [sequence omitted]

SEQ ID NO: 822564 - protein, 417 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDEIFWGDWVIKINLV

SEQ ID NO: 822565 - protein, 392 aa, Homo sapiens; identical to SEQ ID NO: 822561

SEQ ID NO: 822566 - protein, 364 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDG

SEQ ID NO: 822567 - protein, 271 aa, Homo sapiens
PYEDPVIDDKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 822568 - protein, 367 aa, Homo sapiens [sequence omitted]

SEQ ID NO: 822569 - protein, 271 aa, Homo sapiens; identical to SEQ ID NO: 822555

SEQ ID NO: 822570 - protein, 247 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIEREVTGILFLP

SEQ ID NO: 822571 - protein, 249 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEDYRRQNFRFEEKKGAKQQNGNIYAA

SEQ ID NO: 822572 - protein, 1227 aa, Homo sapiens
ARTQPGAARALDAPTAGRTDGRTPSAVPRGSYRRGDRPGLAWTMVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 822573 - protein, 1274 aa, Homo sapiens
ARTQPGAARALDAPTAGRTDGRTPSAVPRGSYRRGDRPGLAWTMVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDQDECLMGAHDCSRRQFCVNTLGSFYCVNHTVLCADGYILNAHRKCVDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 822574 - protein, 479 aa, Homo sapiens
GDSAASDGLALPADINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 822575 - protein, 366 aa, Homo sapiens
GDLEIPGQYWMCGSTDVRASTDVRASTDVLGSTDVRASTDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 822576 - protein, 1212 aa, Homo sapiens
ARTQPGAARALDAPTAGRTDGRTPSAVPRGSYRRGDRPGLAWTMVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGPPAGVAQPRAHTAWEGLGHYCGFYYNFVN

SEQ ID NO: 822577 - protein, 1133 aa, Homo sapiens
ARTQPGAARALDAPTAGRTDGRTPSAVPRGSYRRGDRPGLAWTMVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTWCVPTQAPSGSLHGGPRPWRVPCG

SEQ ID NO: 822578 - protein, 571 aa, Homo sapiens
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 822579 - protein, 571 aa, Homo sapiens; identical to SEQ ID NO: 822578

SEQ ID NO: 822580 - protein, 624 aa, Homo sapiens
AFVLVSTSDMAEETEDAWPRCYLQFLALLLTSTSARAAAAIAAAEEPAGSPSVMTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 822581 - protein, 531 aa, Homo sapiens
MWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 822582 - protein, 460 aa, Homo sapiens
MVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 822583 - protein, 531 aa, Homo sapiens; identical to SEQ ID NO: 822581

SEQ ID NO: 822584 - protein, 571 aa, Homo sapiens; identical to SEQ ID NO: 822578

SEQ ID NO: 822585 - protein, 571 aa, Homo sapiens; identical to SEQ ID NO: 822578

SEQ ID NO: 822586 - protein, 571 aa, Homo sapiens; identical to SEQ ID NO: 822578

SEQ ID NO: 822587 - protein, 571 aa, Homo sapiens; identical to SEQ ID NO: 822578

SEQ ID NO: 822588 - protein, 571 aa, Homo sapiens; identical to SEQ ID NO: 822578

SEQ ID NO: 822589 - protein, 571 aa, Homo sapiens; identical to SEQ ID NO: 822578

SEQ ID NO: 822590 - protein, 571 aa, Homo sapiens; identical to SEQ ID NO: 822578

SEQ ID NO: 822591 - protein, 269 aa, Homo sapiens
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKGKLNTMISPFVLMFRP

SEQ ID NO: 822592 - protein, 133 aa, Homo sapiens
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLVSSQ

SEQ ID NO: 822593 - protein, 166 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPAAWTPSVAHQEGGGIWNPRGPVPAVCS

SEQ ID NO: 822594 - protein, 814 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPGNRGSLSPEEQPKGPWAGVDREGGGVGGIAWWKVACGREPKVQRHSPGDGVSGRRRCPCVGTRQRAGTAGARDDAPSCGVDSVSGPPRRRRNMESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 822595 - protein, 569 aa, Homo sapiens
MVTDVSSGTDRLAVLLQNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 822596 - protein, 801 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPGNRGSLSPEEQPKGPWAGVDREGGGVGGIAWWKVACGREPKVQRHSPGDGVSGRRRCPCVGTRQRAGTAGARDDAPSCGVDSVSGPPRRRRNMESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 822597 - protein, 814 aa, Homo sapiens; identical to SEQ ID NO: 822594

SEQ ID NO: 822598 - protein, 814 aa, Homo sapiens; identical to SEQ ID NO: 822594

SEQ ID NO: 822599 - protein, 814 aa, Homo sapiens; identical to SEQ ID NO: 822594

SEQ ID NO: 822600 - protein, 786 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPGNRGSLSPEEQPKGPWAGVDREGGGVGGIAWWKVACGREPKVQRHSPGDGVSGRRRCPCVGTRQRAGTAGARDDAPSCGVDSVSGPPRRRRNMESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSK

SEQ ID NO: 822601 - protein, 734 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPGNRGSLSPEEQPKGPWAGVDREGGGVGGIAWWKVACGREPKVQRHSPGDGVSGRRRCPCVGTRQRAGTAGARDDAPSCGVDSVSGPPRRRRNMESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVAILGRMLV

SEQ ID NO: 822602 - protein, 752 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPGNRGSLSPEEQPKGPWAGVDREGGGVGGIAWWKVACGREPKVQRHSPGDGVSGRRRCPCVGTRQRAGTAGARDDAPSCGVDSVSGPPRRRRNMESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSATRTRMRPGLLLIRIKVKLG

SEQ ID NO: 822603 - protein, 520 aa, Homo sapiens
AVLPDPGAGLRARTQSCSASRLRIRASTTCFALRPGKWGGDGREGGGGERRKEAAYTRLPVPLLRAARRPLPPLPLLPPLPPEETRRPPVAASCESFLAPGVSCTLPLPLLLSFQYKENKRRYQRKEPLTPFRITQVSPGNRGSLSPEEQPKGPWAGVDREGGGVGGIAWWKVACGREPKVQRHSPGDGVSGRRRCPCVGTRQRAGTAGARDDAPSCGVDSVSGPPRRRRNMESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGICMSALVVLYSSVER

SEQ ID NO: 822604 - protein, 589 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMMLNNPLFAGNPQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 822605 - protein, 589 aa, Homo sapiens; identical to SEQ ID NO: 822604

SEQ ID NO: 822606 - protein, 561 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 822607 - protein, 132 aa, Homo sapiens [sequence omitted]

SEQ ID NO: 822608 - protein, 589 aa, Homo sapiens; identical to SEQ ID NO: 822604

SEQ ID NO: 822609 - protein, 589 aa, Homo sapiens; identical to SEQ ID NO: 822604

SEQ ID NO: 822610 - protein, 589 aa, Homo sapiens; identical to SEQ ID NO: 822604

SEQ ID NO: 822611 - protein, 589 aa, Homo sapiens; identical to SEQ ID NO: 822604

SEQ ID NO: 822612 - protein, 589 aa, Homo sapiens; identical to SEQ ID NO: 822604

SEQ ID NO: 822613 - protein, 589 aa, Homo sapiens; identical to SEQ ID NO: 822604

SEQ ID NO: 822614 - protein, 561 aa, Homo sapiens; identical to SEQ ID NO: 822606

SEQ ID NO: 822615 - protein, 576 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 822616 - protein, 589 aa, Homo sapiens; identical to SEQ ID NO: 822604

SEQ ID NO: 822617 - protein, 412 aa, Homo sapiens
MAESGESGGPPGSQDSAAGAEGAGAPAAAASAEPKIMKVTVKTPKEKEEFAVPENSSVQQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMMLNNPLFAGNPQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 822618 - protein, 589 aa, Homo sapiens; identical to SEQ ID NO: 822604

SEQ ID NO: 822619 - protein, 172 aa, Homo sapiens
MLNNPLFAGNPQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 822620 - protein, 120 aa, Homo sapiens
LQDLRIFPICAFCRFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 822621 - protein, 589 aa, Homo sapiens; identical to SEQ ID NO: 822604

SEQ ID NO: 822622 - protein, 141 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSIPNCWGGTFL

SEQ ID NO: 822623 - protein, 503 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMMLNNPLFAGNPQLQEQMRQQLPTFLQQMQNPDTLSAMSNPRAMQALLQIQQGLQTLATEAPGLIPGVLLAGGIRKIARGKEATRVR

SEQ ID NO: 822624 - protein, 258 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTTFWNFAQNPTNDAENEERNP

SEQ ID NO: 822625 - protein, 458 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 822626 - protein, 492 aa, Homo sapiens
RTRAPRGARSACTRGRRRRPVPSLKVLSPFAVVQMRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 822627 - protein, 458 aa, Homo sapiens; identical to SEQ ID NO: 822625

SEQ ID NO: 822628 - protein, 117 aa, Homo sapiens
ERDVQEKRRSVPCPSPGPLGFDHLRCVETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 822629 - protein, 492 aa, Homo sapiens; identical to SEQ ID NO: 822626

SEQ ID NO: 822630 - protein, 492 aa, Homo sapiens; identical to SEQ ID NO: 822626

SEQ ID NO: 822631 - protein, 483 aa, Homo sapiens
RTRAPRGARSACTRGRRRRPVPSLKVLSPFAVVQMRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRIGHRVKRPSCL

SEQ ID NO: 822632 - protein, 1129 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822633 - protein, 1129 aa, Homo sapiens; identical to SEQ ID NO: 822632

SEQ ID NO: 822634 - protein, 986 aa, Homo sapiens
MEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822635 - protein, 1111 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNEEENFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822636 - protein, 895 aa, Homo sapiens
LTQDTYLVQFPDIKNRIAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822637 - protein, 874 aa, Homo sapiens
NRQLEGISVVAQQFHETLEPLNEWLTTIEKRLVNCEPIGTQASKLEEQIAQHKALEDDIINHNETFTPGDDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822638 - protein, 1111 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDAEFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822639 - protein, 948 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIGWQPLSLPLPSFLFSFLLFHSCFSHLF

SEQ ID NO: 822640 - protein, 504 aa, Homo sapiens
MEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822641 - protein, 1153 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822642 - protein, 1129 aa, Homo sapiens; identical to SEQ ID NO: 822632

SEQ ID NO: 822643 - protein, 1129 aa, Homo sapiens; identical to SEQ ID NO: 822632

SEQ ID NO: 822644 - protein, 1129 aa, Homo sapiens; identical to SEQ ID NO: 822632

SEQ ID NO: 822645 - protein, 1092 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822646 - protein, 293 aa, Homo sapiens
MHCKGMHLTFCYAELELAWQKDVLEILNVISGARWPFFPLTIERLFFSVFSLCALLCVYNPAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822647 - protein, 1010 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMERQYKEASFDFQDIYQGKASTLGRTVA

SEQ ID NO: 822648 - protein, 1092 aa, Homo sapiens; identical to SEQ ID NO: 822645

SEQ ID NO: 822649 - protein, 1164 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASEHLLFKFERCKIWCRNSCEILQEASLKFCRWPYLCICLFILSV

SEQ ID NO: 822650 - protein, 189 aa, Homo sapiens
MELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822651 - protein, 182 aa, Homo sapiens
MTLEYLQCHQVAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 822652 - protein, 1157 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASPKDPVINSEFYTGWLDHWGQPHSTIKTEAVASSLYD

SEQ ID NO: 822653 - protein, 429 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKVLLSGTFYFILFDYSECTGNVNHLN

SEQ ID NO: 822654 - protein, 745 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDLMLTTGILWNDMHPDT

SEQ ID NO: 822655 - protein, 750 aa, Homo sapiens
NLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEEVWKFIPSTPHCHLPSFLITHCHCQNLGIF

SEQ ID NO: 822656 - protein, 357 aa, Homo sapiens
NRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEK

SEQ ID NO: 822657 - protein, 248 aa, Homo sapiens
NRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEK

SEQ ID NO: 822658 - protein, 1475 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPTSSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 822659 - protein, 1475 aa, Homo sapiens [sequence omitted]

SEQ ID NO: 822660 - protein, 1457 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPTSSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 822661 - protein, 1403 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPTSSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 822662 - protein, 1384 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPTSSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 822663 - protein, 1091 aa, Homo sapiens
MTEFLVFDCQETNQRIDYKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPTSSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 822664 - protein, 1448 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPTSSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVG

SEQ ID NO: 822665 - protein, 1475 aa, Homo sapiens; identical to SEQ ID NO: 822658

SEQ ID NO: 822666 - protein, 1475 aa, Homo sapiens; identical to SEQ ID NO: 822658

SEQ ID NO: 822667 - protein, 1475 aa, Homo sapiens; identical to SEQ ID NO: 822658

SEQ ID NO: 822668 - protein, 575 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERHAFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSGK

SEQ ID NO: 822669 - protein, 333 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSALLIYSLISLPEFTRRSQRWFKINTSICCYGNWLLV

SEQ ID NO: 822670 - protein, 194 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSHQDPEQSQLQHIHQQTMFNQ

SEQ ID NO: 822671 - protein, 519 aa, Homo sapiens
MFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822672 - protein, 519 aa, Homo sapiens; identical to SEQ ID NO: 822671

SEQ ID NO: 822673 - protein, 340 aa, Homo sapiens
MVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKKLHPFGSLQQEMGPVNSTNATQDRSFTSPGQTLIG

SEQ ID NO: 822674 - protein, 307 aa, Homo sapiens
RPVTNSWDWLPAGAAPEAVPCRHMPLSRLPLRVGQKEFFFPLPLLVPPISWLLLSESQPRLVPGSPVIRPGFQRACVAAACTVAARCPGRGVGDRSQSGASCRPIWGPKVGGPTEMLRGMYLTRNGNLQRRHTMKEAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822675 - protein, 924 aa, Homo sapiens
SLRPLRDPLLRMPGGGDTENGKKLKITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822676 - protein, 935 aa, Homo sapiens
AGGELGFHGAAAEAGPAAMNRFNGLCKVCSERRYRQITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822677 - protein, 519 aa, Homo sapiens; identical to SEQ ID NO: 822671

SEQ ID NO: 822678 - protein, 569 aa, Homo sapiens
VWGRQPLDTAARSCHSHGRPPAGGAGWKPGRASWQERQPGVAWVPAGVCWMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822679 - protein, 365 aa, Homo sapiens [sequence omitted]

SEQ ID NO: 822680 - protein, 307 aa, Homo sapiens; identical to SEQ ID NO: 822674

SEQ ID NO: 822681 - protein, 168 aa, Homo sapiens
MKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822682 - protein, 289 aa, Homo sapiens
GQSQIAGTGFLPGRPQRLSLADTCPFHGSLSGLARRNFFFRSPSWSLPFPGSSCLSPAPACAWESSHQARIPESVCGCSLHRCCPLPRTRGGGQEPEWCLLQTNLGPQGGGPYRDAPRAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822683 - protein, 260 aa, Homo sapiens
MRCLLTVPRLCASHGAEVLQEYAFRGCNRHIVQWRNLSTGADQHRLKDAEDALRAQVYSLISCECRKGGEHVAKDARNTSFVLLSACHVAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 822684 - protein, 307 aa, Homo sapiens; identical to SEQ ID NO: 822674

SEQ ID NO: 822685 - protein, 188 aa, Homo sapiens
MFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQEPAPSQEPLSSKDSATSEGSPPGPDAPPSKDVPPCQEPPPAKTSHPARTYLLVKNPCLTHPPH

SEQ ID NO: 822686 - protein, 113 aa, Homo sapiens
MWMSTEGPQWCERPCGHAETGSRKSQEERTQRLLPSKEEEEEDIPHLGFQWWLPDLPWGQQERLGEVTLMKNNAMICCCQRTSPPIHSFSTCTHWLIHSMDISGASTLCQALC

SEQ ID NO: 822687 - protein, 321 aa, Homo sapiens
RPGGAGGSHVGARAHMTGRAMDPLPAAAVGAAAEAEADEEADPPASDLPTPQAIEPQAIVQQVPAPSRMQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGVPEAGSERPVCGIRAARRQGCTTG

SEQ ID NO: 822688 - protein, 83 aa, Homo sapiens
DYFKIEKEFGASQRGPTRLEGRLPGAIQKWSPCVARAGLELLTSSDLPASASESVGITGMTRHTGLECTDLICYKLKNLHSYA

SEQ ID NO: 822689 - protein, 321 aa, Homo sapiens; identical to SEQ ID NO: 822687

SEQ ID NO: 822690 - protein, 251 aa, Homo sapiens
MPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGVPEAGSERPVCGIRAARRQGCTTG

SEQ ID NO: 822691 - protein, 304 aa, Homo sapiens
DYFKIEKEFGASQRGPTRLEGRLPGAIQKYLPTPQAIEPQAIVQQVPAPSRMQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGVPEAGSERPVCGIRAARRQGCTTG

SEQ ID NO: 822692 - protein, 310 aa, Homo sapiens
SGLLHPCPEPSPLAWATSMHPGLPSTLTCSCSLMSDLPTPQAIEPQAIVQQVPAPSRMQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGVPEAGSERPVCGIRAARRQGCTTG

SEQ ID NO: 822693 - protein, 251 aa, Homo sapiens; identical to SEQ ID NO: 822690

SEQ ID NO: 822694 - protein, 208 aa, Homo sapiens
RPGGAGGSHVGARAHMTGRAMDPLPAAAVGAAAEAEADEEADPPASDLPTPQAIEPQAIVQQVPAPSRMQMPQGNPLLLSHTDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGVPEAGSERPVCGIRAARRQGCTTG

SEQ ID NO: 822695 - protein, 105 aa, Homo sapiens
MFHAKFIWSNSSLYDDVEQENAIQTMELRNYFSLYCLHQETQLIHVYLPLTSHILRAFVNSQIQGHKEMSKVWNDLRPKLSCLFAGPHSTLTPPCSPPEDGLCPH

SEQ ID NO: 822696 - protein, 509 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 822697 - protein, 509 aa, Homo sapiens; identical to SEQ ID NO: 822696

SEQ ID NO: 822698 - protein, 509 aa, Homo sapiens; identical to SEQ ID NO: 822696

SEQ ID NO: 822699 - protein, 562 aa, Homo sapiens
AHDRARTRPGVTDPPCLCGLRARSPRLCRLCRRPRLLPGAEPCEPRVGPRRADMGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 822700 - protein, 509 aa, Homo sapiens; identical to SEQ ID NO: 822696

SEQ ID NO: 822701 - protein, 515 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQNRVKPFLCGFNVNYKLAWLSSRRNAIYFGVVVKRAQRIRRPFRPILNP

SEQ ID NO: 822702 - protein, 509 aa, Homo sapiens; identical to SEQ ID NO: 822696

SEQ ID NO: 822703 - protein, 506 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQGPEDTVSQPGLAAGPDRPPSPYTPLLPDSPSGQPPSPTA

SEQ ID NO: 822704 - protein, 509 aa, Homo sapiens; identical to SEQ ID NO: 822696

SEQ ID NO: 822705 - protein, 509 aa, Homo sapiens; identical to SEQ ID NO: 822696

SEQ ID NO: 822706 - protein, 509 aa, Homo sapiens; identical to SEQ ID NO: 822696

SEQ ID NO: 822707 - protein, 509 aa, Homo sapiens; identical to SEQ ID NO: 822696

SEQ ID NO: 822708 - protein, 509 aa, Homo sapiens; identical to SEQ ID NO: 822696

SEQ ID NO: 822709 - protein, 525 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLFLQPKLTSSYGLSRPLSGRSGRRLCPRAAPTPSQGPSDYRCPG

SEQ ID NO: 822710 - protein, 509 aa, Homo sapiens; identical to SEQ ID NO: 822696

SEQ ID NO: 822711 - protein, 509 aa, Homo sapiens; identical to SEQ ID NO: 822696

SEQ ID NO: 822712 - protein, 589 aa, Homo sapiens
ASRAEEKMEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 822713 - protein, 601 aa, Homo sapiens
ASRAEEKMEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 822714 - protein, 606 aa, Homo sapiens
ASRAEEKMEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSESDHRDELSDWSLAPTEEERESFLRRGDGRRRGGGGRGQGGRGRGGGFKGNDDHSRTDNRPRNPREAKGRTTDGSLQIRVDCNNERSVHTKTLQNTSSEGSRLRTGKDRNQKKEKPDSVDGQQPLVNGVP

SEQ ID NO: 822715 - protein, 589 aa, Homo sapiens; identical to SEQ ID NO: 822712

SEQ ID NO: 822716 - protein, 589 aa, Homo sapiens; identical to SEQ ID NO: 822712

SEQ ID NO: 822717 - protein, 589 aa, Homo sapiens; identical to SEQ ID NO: 822712

SEQ ID NO: 822718 - protein, 568 aa, Homo sapiens
ASRAEEKMEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQKKT

SEQ ID NO: 822719 - protein, 521 aa, Homo sapiens
MGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVKIMQNCCGEKANILEKEKMYPMALLLWNRAAIQGNAFARVKIGDYHYYGYGTKKDYQTAATHYSIAANKYHNAQAMFNLAYMYEHGLGITKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 822720 - protein, 643 aa, Homo sapiens [sequence omitted]

SEQ ID NO: 822721 - protein, 108 aa, Homo sapiens
MAPIIRLPKGIRNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822722 - protein, 64 aa, Homo sapiens
MTKLRAQQCRFWTSFFPKVLEMTGNIDEAEWEWKAGFHRWNNYMMDWKNQFNDYTSKKESCVGL

SEQ ID NO: 822723 - protein, 108 aa, Homo sapiens; identical to SEQ ID NO: 822721

SEQ ID NO: 822724 - protein, 64 aa, Homo sapiens; identical to SEQ ID NO: 822722

SEQ ID NO: 822725 - protein, 64 aa, Homo sapiens; identical to SEQ ID NO: 822722

SEQ ID NO: 822726 - protein, 106 aa, Homo sapiens
MSNALLHGYTNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822727 - protein, 129 aa, Homo sapiens
ISMLITAPVNRHATAAWNPNETQNNSTSWPVFKSTEQKYLTLNTESTRIMTKLRAQQCRFWTSFFPKVLEMTGNIDEAEWEWKAGFHRWNNYMMDWKNQFNDYTTACARFYLKHQPFINSCPLKQAPIR

SEQ ID NO: 822728 - protein, 112 aa, Homo sapiens
LRQRITKTRHTQNMSKNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822729 - protein, 108 aa, Homo sapiens
NISVCIFPNCFRNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822730 - protein, 109 aa, Homo sapiens
GARPAPALGGFSENPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822731 - protein, 126 aa, Homo sapiens
LHQLVFFHQILNYNSGHFLITPPRGIPIRLNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822732 - protein, 117 aa, Homo sapiens
RGEAQKGKDQPRFWVRNHESSNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822733 - protein, 171 aa, Homo sapiens
SYRSVHKDAATEHKGAGRHRGSNFRNPNETQNNSTSWPVFKSTEQKYLTLNTESTRIMTKLRAQQCRFWTSFFPKVLEMTAAPEIPVEITVGSDQPLLSTVLLTGLFWKNKFIHTPLIDHKRPTAPRIIHRAFNNFHRPLHPQLNPLPVKAQSLLMPLLINTLDPIPNNGP

SEQ ID NO: 822734 - protein, 122 aa, Homo sapiens
RAGPPGLPRTGLGVSSLPSDNINEARNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822735 - protein, 122 aa, Homo sapiens; identical to SEQ ID NO: 822734

SEQ ID NO: 822736 - protein, 123 aa, Homo sapiens
TPQIKVYGYNILTFRCQVLLEFTTRYKNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822737 - protein, 136 aa, Homo sapiens
MSYDFFPYTHTTQKARQQKGVLQYIPHLSNLIILSARSKNSKYIIANEPKRAVFYNGLAQKYLTLNTESTRIMTKLRAQQCRFWTSFFPKVLEMTGNIDEAEWEWKAGFHRWNNYMMDWKNQFNDYTSKKESCVGL

SEQ ID NO: 822738 - protein, 133 aa, Homo sapiens
PSYISPLARPHPQVFLPLIRAHQLFIVPAAQTSTITSPENTNLPFFQTPLPQLSTFQPRVPEINPHLGAPQFWFLPPFFPKVLAIHPISIKPRNIDEAEWEWKAGFHRWNNYMMDWKNQFNDYTSKKESCVGL

SEQ ID NO: 822739 - protein, 107 aa, Homo sapiens
MLCQYSVIAQKYDTSISINTLPQPTLSALITYNSHRYRTNRVIRANDVSTSPPTPIKTIIGHAKSRKYQSDLMNQYGMWTQYSHLWPIDTDGLHNPIPRKKESCVGL

SEQ ID NO: 822740 - protein, 104 aa, Homo sapiens
RGDALYHRHKDILMCAGSIRTQNEVSAQIAQHALLSKASTKKNHTLRPKVNQEMRAEITVLTKCGFWHIIFSKKFLEITAKFIKEILMKQNGSGKQDSIAGTIT

SEQ ID NO: 822741 - protein, 64 aa, Homo sapiens; identical to SEQ ID NO: 822722

SEQ ID NO: 822742 - protein, 109 aa, Homo sapiens
RSETDSLLNQRYRNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 822743 - protein, 109 aa, Homo sapiens; identical to SEQ ID NO: 822742

SEQ ID NO: 822744 - protein, 109 aa, Homo sapiens; identical to SEQ ID NO: 822742

SEQ ID NO: 822745 - protein, 109 aa, Homo sapiens; identical to SEQ ID NO: 822742

SEQ ID NO: 822746 - protein, 109 aa, Homo sapiens; identical to SEQ ID NO: 822742

SEQ ID NO: 822747 - protein, 109 aa, Homo sapiens; identical to SEQ ID NO: 822742

SEQ ID NO: 822748 - protein, 109 aa, Homo sapiens; identical to SEQ ID NO: 822742

SEQ ID NO: 822749 - protein, 69 aa, Homo sapiens
RSETDSLLNQRYRNPNETQNNSTSWPVFKSTEQKYLTLNTESTRIMTKLRAQQCRFWTSFFPKVLEMTG

SEQ ID NO: 822750 - protein, 101 aa, Homo sapiens
RSETDSLLNQRYRNPNETQNNSTSWPVFKSTEQKYLTLNTERAQQCRFWTSFFPKVLEMTGNIDEAEWEWKAGFHRWNNYMMDWKNQFNDYTSKKESCVGL

SEQ ID NO: 822751 - protein, 109 aa, Homo sapiens; identical to SEQ ID NO: 822742

SEQ ID NO: 822752 - protein, 109 aa, Homo sapiens; identical to SEQ ID NO: 822742

SEQ ID NO: 822753 - protein, 109 aa, Homo sapiens; identical to SEQ ID NO: 822742

SEQ ID NO: 822754 - protein, 109 aa, Homo sapiens; identical to SEQ ID NO: 822742

SEQ ID NO: 822755 - protein, 109 aa, Homo sapiens; identical to SEQ ID NO: 822742

SEQ ID NO: 822756 - protein, 109 aa, Homo sapiens; identical to SEQ ID NO: 822742

SEQ ID NO: 822757 - protein, 109 aa, Homo sapiens; identical to SEQ ID NO: 822742

SEQ ID NO: 822758 - protein, 109 aa, Homo sapiens; identical to SEQ ID NO: 822742

SEQ ID NO: 822759 - protein, 109 aa, Homo sapiens; identical to SEQ ID NO: 822742

SEQ ID NO: 822760 - protein, 77 aa, Homo sapiens
RSETDSLLNQRYRNPNETQNNSTSWPVFKSTEQKYLTLNTESTRIMTKLFWTSFFPKVLEMTGNIDEAEWEWKAGIT

SEQ ID NO: 822761 - protein, 109 aa, Homo sapiens; identical to SEQ ID NO: 822742

SEQ ID NO: 822762 - protein, 109 aa, Homo sapiens; identical to SEQ ID NO: 822742

SEQ ID NO: 822763 - protein, 109 aa, Homo sapiens; identical to SEQ ID NO: 822742

SEQ ID NO: 822764 - protein, 109 aa, Homo sapiens; identical to SEQ ID NO: 822742

SEQ ID NO: 822765 - protein, 109 aa, Homo sapiens; identical to SEQ ID NO: 822742

SEQ ID NO: 822766 - protein, 109 aa, Homo sapiens; identical to SEQ ID NO: 822742

SEQ ID NO: 822767 - protein, 109 aa, Homo sapiens; identical to SEQ ID NO: 822742

SEQ ID NO: 822768 - protein, 109 aa, Homo sapiens; identical to SEQ ID NO: 822742

SEQ ID NO: 822769 - protein, 109 aa, Homo sapiens; identical to SEQ ID NO: 822742

SEQ ID NO: 822770 - protein, 109 aa, Homo sapiens; identical to SEQ ID NO: 822742

SEQ ID NO: 822771 - protein, 102 aa, Homo sapiens
RSETDSLLNQRYRNPNETQNNSTSWPVFKSTEQKYLTLNTESTRIMTKLRAQQCRFWTSFFPKVLEMTGNIDEAEWEWKAGFHRWNNYMMDWKNQFNDYTIE

SEQ ID NO: 822772 - protein, 77 aa, Homo sapiens; identical to SEQ ID NO: 822760

SEQ ID NO: 822773 - protein, 101 aa, Homo sapiens; identical to SEQ ID NO: 822750

SEQ ID NO: 822774 - protein, 77 aa, Homo sapiens; identical to SEQ ID NO: 822760

SEQ ID NO: 822775 - protein, 142 aa, Homo sapiens
MSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 822776 - protein, 159 aa, Homo sapiens
MCEAGVLEKKRPVDRTIMSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 822777 - protein, 142 aa, Homo sapiens; identical to SEQ ID NO: 822775

SEQ ID NO: 822778 - protein, 106 aa, Homo sapiens
MIVTRKSFTLHDHESVHSVVIYRLESTHDLRFVVYSYKYVHDDGRVSYPLCFIFSSPVGCKPEQQMMYAGSKNRLVQTAELTKVFEIRTTDDLTEAWLQEKLSFFR

SEQ ID NO: 822779 - protein, 138 aa, Homo sapiens
MSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVQTGMGLQSVRERWCGSWV

SEQ ID NO: 822780 - protein, 147 aa, Homo sapiens
VLDETFLLLHSPPPYSPGPHAKKTAELRKEEACGQNNHVKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 822781 - protein, 444 aa, Homo sapiens
KRRRHRLPALPPRLLSPSAATMSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 822782 - protein, 433 aa, Homo sapiens
SLGRGGCQIGRGRSAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 822783 - protein, 402 aa, Homo sapiens
KRRRHRLPALPPRLLSPSAATMSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPVRYMKIIEKSGYQALPWVRYITQSGDYQLRTS

SEQ ID NO: 822784 - protein, 459 aa, Homo sapiens
KRRRHRLPALPPRLLSPSAATMSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGGWERNSLCFPRPWSFPHPPDFI

SEQ ID NO: 822785 - protein, 92 aa, Homo sapiens
VDSTPLALTVLKRLGLDHDLHAAVGELLHDADSPRFKTSVGSAKYVPERNVVIWSIKSFPVRYMKIIEKSGYQALPWVRYITQSGDYQLRTS

SEQ ID NO: 822786 - protein, 278 aa, Homo sapiens
MSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQSAWSDGLLGGPTGGQDGGVKAAGGMRGALNGL

SEQ ID NO: 822787 - protein, 84 aa, Homo sapiens
KRRRHRLPALPPRLLSPSAATMSASAVFILDVKGKPLISRNYKGDVAMSKIEHFMPLLVQREEEGALAPLLSLSGCCGSLLHSR

SEQ ID NO: 822788 - protein, 325 aa, Homo sapiens
MALADSTRGLPNGGGGGGGSGSSSSSAEPPLFPDIVELNVGGQVYVTRRCTVVSVPDSLLWRMFTQQQPQELARDSKGRFFLDRDGFLFRYILDYLRDLQLVLPDYFPERSRLQREAEYFELPELVRRLGAPQQPGPGPPPSRRGVHKEGSLGDELLPLGYSEPEQQEGASAGAPSPTLELASRSPSGGAAGPLLTPSQSLDGSRRSGYITIGYRGSYTIGRDAQADAKFRRVARITVCGKTSLAKEVFGDTLNESRDPDRPPERYTSRYYLKFNFLEQAFDKLSESGFHMVACSSTGTCAFASSTDQSEDKIWTSYTEYVFCRE

SEQ ID NO: 822789 - protein, 325 aa, Homo sapiens; identical to SEQ ID NO: 822788

SEQ ID NO: 822790 - protein, 325 aa, Homo sapiens; identical to SEQ ID NO: 822788

SEQ ID NO: 822791 - protein, 325 aa, Homo sapiens; identical to SEQ ID NO: 822788

SEQ ID NO: 822792 - protein, 325 aa, Homo sapiens; identical to SEQ ID NO: 822788

SEQ ID NO: 822793 - protein, 205 aa, Homo sapiens
MSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 822794 - protein, 205 aa, Homo sapiens; identical to SEQ ID NO: 822793

SEQ ID NO: 822795 - protein, 255 aa, Homo sapiens
AGLPAWGTRGGVEAAGGRAGAVSLGFCPPQPYREPEPSVAEPPSCPLALNMSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 822796 - protein, 255 aa, Homo sapiens; identical to SEQ ID NO: 822795

SEQ ID NO: 822797 - protein, 120 aa, Homo sapiens
TQAEPLACSSRSKVTETNCQLPLAYQEHLEMDDMSPRLRAFLSEPIGEKDVCWVDGISHELAINLVTKGINKAYILLGQFLLMHKNEAEFQRWLICCFGATECEAQQTSHCLKEWCACFL

SEQ ID NO: 822798 - protein, 216 aa, Homo sapiens
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCSPIQFESAWALTNIASGTSEQTKAVVDGGAIPAFISLLASPHAHISEQAVWALGNIAGDGSVFRDLVIKVRCQLNHCWVSLQS

SEQ ID NO: 822799 - protein, 2940 aa, Homo sapiens
APPAPAPPPSLSFSPRLGSDMRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEVGDFTSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSQSDSSVLRMSDPSHTTNKLYPKDRVLDDVSIRSPETKCPKQNSIENDIEEKVSDLASRGQEPTKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSTKKSIFVLPNDDLKKLARKGGIREVPYFNYNAKPALDIWPYPSPRPTFGITWRYRLQTVKSLAGVSLMLRLLWASLRWDDMAAKVPPGGGSTRTETSETEITTTEIIKRRDVGPYGIRFEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAKAQPQTAQPSARPQPQTQPQSPAQPEVQTQPEVQTQTTVSSHVPSEAQPTHAQSSKPQVAAQSQPQSNVQGQSPVQCPKSITDSNTSINSIPTVSWTTIPGSDYNLTTDSNSTTYISSDTFPRPATVTTPGQSSTQTLSSGQTLNQVSVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPVLPAPPAPPPSPPPPPGVQHTGLLSTPTLPVASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 822800 - protein, 221 aa, Homo sapiens
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCSPIQFESAWALTNIASGTSEQTKAVVDGGAIPAFISLLASPHAHISEQAVWALGNIAGDGSVFRDLVIKVRCQLTHCWLSLQFLICHL

SEQ ID NO: 822801 - protein, 221 aa, Homo sapiens; identical to SEQ ID NO: 822800

SEQ ID NO: 822802 - protein, 221 aa, Homo sapiens; identical to SEQ ID NO: 822800

SEQ ID NO: 822803 - protein, 221 aa, Homo sapiens; identical to SEQ ID NO: 822800

SEQ ID NO: 822804 - protein, 221 aa, Homo sapiens; identical to SEQ ID NO: 822800

SEQ ID NO: 822805 - protein, 221 aa, Homo sapiens; identical to SEQ ID NO: 822800

SEQ ID NO: 822806 - protein, 221 aa, Homo sapiens; identical to SEQ ID NO: 822800

SEQ ID NO: 822807 - protein, 221 aa, Homo sapiens; identical to SEQ ID NO: 822800

SEQ ID NO: 822808 - protein, 221 aa, Homo sapiens; identical to SEQ ID NO: 822800

SEQ ID NO: 822809 - protein, 221 aa, Homo sapiens; identical to SEQ ID NO: 822800

SEQ ID NO: 822810 - protein, 221 aa, Homo sapiens; identical to SEQ ID NO: 822800

SEQ ID NO: 822811 - protein, 221 aa, Homo sapiens; identical to SEQ ID NO: 822800

SEQ ID NO: 822812 - protein, 221 aa, Homo sapiens; identical to SEQ ID NO: 822800

SEQ ID NO: 822813 - protein, 221 aa, Homo sapiens; identical to SEQ ID NO: 822800

SEQ ID NO: 822814 - protein, 221 aa, Homo sapiens; identical to SEQ ID NO: 822800

SEQ ID NO: 822815 - protein, 221 aa, Homo sapiens; identical to SEQ ID NO: 822800

SEQ ID NO: 822816 - protein, 221 aa, Homo sapiens; identical to SEQ ID NO: 822800

SEQ ID NO: 822817 - protein, 221 aa, Homo sapiens; identical to SEQ ID NO: 822800

SEQ ID NO: 822818 - protein, 221 aa, Homo sapiens; identical to SEQ ID NO: 822800

SEQ ID NO: 822819 - protein, 221 aa, Homo sapiens; identical to SEQ ID NO: 822800

SEQ ID NO: 822820 - protein, 221 aa, Homo sapiens; identical to SEQ ID NO: 822800

SEQ ID NO: 822821 - protein, 221 aa, Homo sapiens; identical to SEQ ID NO: 822800

SEQ ID NO: 822822 - protein, 221 aa, Homo sapiens; identical to SEQ ID NO: 822800

SEQ ID NO: 822823 - protein, 221 aa, Homo sapiens; identical to SEQ ID NO: 822800

SEQ ID NO: 822824 - protein, 221 aa, Homo sapiens; identical to SEQ ID NO: 822800

SEQ ID NO: 822825 - protein, 221 aa, Homo sapiens; identical to SEQ ID NO: 822800

SEQ ID NO: 822826 - protein, 221 aa, Homo sapiens; identical to SEQ ID NO: 822800

SEQ ID NO: 822827 - protein, 221 aa, Homo sapiens; identical to SEQ ID NO: 822800

SEQ ID NO: 822828 - protein, 451 aa, Homo sapiens
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCSPIQFESAWALTNIASGTSEQTKAVVDGGAIPAFISLLASPHAHISEQAVWALGNIAGDGSVFRDLVIKVRCQLTTVGSPCSPDMSSLACGYLRNLTWTLSNLCRNKNPAPPIDAVEQILPTLVRLLHHDDPEVLADTCWAISYLTDGPNERIGMVVKTGVVPQLVKLLGASELPIVTPALRAIGNIVTGTDEQTQVVIDAGALAVFPSLLTNPKTNIQKEATWTMSNITAGRQDQIQQVVNHGLVPFLVSVLSKADFKTQKEAVWAVTNYTSGGTVEQIVYLVHCGIIEPLMNLLTAKDTKIILVILDAISNIFPGC

SEQ ID NO: 822829 - protein, 474 aa, Homo sapiens
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCSPIQFESAWALTNIASGTSEQTKAVVDGGAIPAFISLLASPHAHISEQAVWALGNIAGDGSVFRDLVIKVRCQLNHCWVSLQWVNCTVLKTKSRNTDPLLALLAVPDMSSLACGYLRNLTWTLSNLCRNKNPAPPIDAVEQILPTLVRLLHHDDPEVLADTCWAISYLTDGPNERIGMVVKTGVVPQLVKLLGASELPIVTPALRAIGNIVTGTDEQTQVVIDAGALAVFPSLLTNPKTNIQKEATWTMSNITAGRQDQIQQVVNHGLVPFLVSVLSKADFKTQKEAVWAVTNYTSGGTVEQIVYLVHCGIIEPLMNLLTAKDTKIILVILDAISNIFPGC

SEQ ID NO: 822830 - protein, 221 aa, Homo sapiens; identical to SEQ ID NO: 822800

SEQ ID NO: 822831 - protein, 234 aa, Homo sapiens
MSSLACGYLRNLTWTLSNLCRNKNPAPPIDAVEQILPTLVRLLHHDDPEVLADTCWAISYLTDGPNERIGMVVKTGVVPQLVKLLGASELPIVTPALRAIGNIVTGTDEQTQVVIDAGALAVFPSLLTNPKTNIQKEATWTMSNITAGRQDQIQQVVNHGLVPFLVSVLSKADFKTQKEAVWAVTNYTSGGTVEQIVYLVHCGIIEPLMNLLTAKDTKIILVILDAISNIFPGC

SEQ ID NO: 822832 - protein, 221 aa, Homo sapiens; identical to SEQ ID NO: 822800

SEQ ID NO: 822833 - protein, 217 aa, Homo sapiens
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCSPIQFESAWALTNIASGTSEQTKAVVDGGAIPAFISLLASPHAHISEQAVWALGNIAGDGSVFRDLVIKVRCQLNHMFGSPCQS

SEQ ID NO: 822834 - protein, 216 aa, Homo sapiens; identical to SEQ ID NO: 822798

SEQ ID NO: 822835 - protein, 268 aa, Homo sapiens
GLPWFQRVTGNKGSSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822836 - protein, 305 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822837 - protein, 305 aa, Homo sapiens; identical to SEQ ID NO: 822836

SEQ ID NO: 822838 - protein, 305 aa, Homo sapiens; identical to SEQ ID NO: 822836

SEQ ID NO: 822839 - protein, 305 aa, Homo sapiens; identical to SEQ ID NO: 822836

SEQ ID NO: 822840 - protein, 305 aa, Homo sapiens; identical to SEQ ID NO: 822836

SEQ ID NO: 822841 - protein, 305 aa, Homo sapiens; identical to SEQ ID NO: 822836

SEQ ID NO: 822842 - protein, 305 aa, Homo sapiens; identical to SEQ ID NO: 822836

SEQ ID NO: 822843 - protein, 305 aa, Homo sapiens; identical to SEQ ID NO: 822836

SEQ ID NO: 822844 - protein, 274 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822845 - protein, 189 aa, Homo sapiens
MTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822846 - protein, 292 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPRTELTPAYF

SEQ ID NO: 822847 - protein, 182 aa, Homo sapiens
ASRVMKIVSGAGRYPRKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822848 - protein, 244 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822849 - protein, 334 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPRPHLSAYEGPARKVTNLSQCGLVQPCVFCNPCLWYEIMSPIFLSHNMHLLS

SEQ ID NO: 822850 - protein, 119 aa, Homo sapiens
MSLLSPWPPVVTEPSSPHFPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 822851 - protein, 213 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 822852 - protein, 189 aa, Homo sapiens
RACTPLAHTPTGARGVPLAGGAGGRGSVEGIGLPSGCGRMRGGCGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 822853 - protein, 166 aa, Homo sapiens
MAAAAAAGEARRVLVYGGRGALGSRCVQAFRARNWIGVTTDTIWPAKPKWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 822854 - protein, 182 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 822855 - protein, 190 aa, Homo sapiens
MWTSTISSHLATKHLKEGGLLTLAGAKAALDGTPGMIGYGGRGALGSRCVQAFRARNWWVASVDVVENEEASASIIVKMTDSFTEQADQVTAEVGKLLGEEKVDAILCVAGGWAGGNAKSKFICVHCRVTLDTPMNRKSMPEADFSSWTPLEFLVETFHDWITGKNRPSSGSLIQVVTTEGRTELTPAYF

SEQ ID NO: 822856 - protein, 129 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQNA

SEQ ID NO: 822857 - protein, 223 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPELSMTGSQGKTDRAQEA

SEQ ID NO: 822858 - protein, 280 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVEPTLPPHLRY

SEQ ID NO: 822859 - protein, 246 aa, Homo sapiens
VTVPPGGGAPRAWQRARRQQRARSGARPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKLRKPNPGGNHRRKDGTHPSIFLGLISVPMRGLPEKSLTCLSVALSSLVFSVTPVCGTR

SEQ ID NO: 822860 - protein, 167 aa, Homo sapiens
MWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPRPHLSAYEGPARKVTNLSQCGLVQPCVFCNPCLWYEIMSPIFLSHNMHLLS

SEQ ID NO: 822861 - protein, 310 aa, Homo sapiens
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKAYQDQELGAKSNPEKGHQEKTDSRQSQKEQSPATIQSLGKGRNKRQSQPENSCHADSEKRPRWSARESCQRYAWKIYSADIEINRAYRETPRKEEPEEKDNEELHKTEKDNEQEKESRIRRSHKKKARRNQDKMKTRDEYLTESRKLNKPPKSVKKVGLSHLEQLEAKKRIIVPKRRKGSTRE

SEQ ID NO: 822862 - protein, 261 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 822863 - protein, 261 aa, Homo sapiens; identical to SEQ ID NO: 822862

SEQ ID NO: 822864 - protein, 261 aa, Homo sapiens; identical to SEQ ID NO: 822862

SEQ ID NO: 822865 - protein, 261 aa, Homo sapiens; identical to SEQ ID NO: 822862

SEQ ID NO: 822866 - protein, 261 aa, Homo sapiens; identical to SEQ ID NO: 822862

SEQ ID NO: 822867 - protein, 111 aa, Homo sapiens
SLSVSAYLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 822868 - protein, 162 aa, Homo sapiens
IPAHAQTPNLQLPTSPSALASYSPSTTDMAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 822869 - protein, 152 aa, Homo sapiens
IPAHAQTPNLQLPTSPSALASYSPSTTDMAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKR

SEQ ID NO: 822870 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 822871 - protein, 198 aa, Homo sapiens; identical to SEQ ID NO: 822870

SEQ ID NO: 822872 - protein, 159 aa, Homo sapiens
MTLPILRFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 822873 - protein, 164 aa, Homo sapiens
PLLVYNYYQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 822874 - protein, 198 aa, Homo sapiens; identical to SEQ ID NO: 822870

SEQ ID NO: 822875 - protein, 198 aa, Homo sapiens; identical to SEQ ID NO: 822870

SEQ ID NO: 822876 - protein, 198 aa, Homo sapiens; identical to SEQ ID NO: 822870

SEQ ID NO: 822877 - protein, 159 aa, Homo sapiens
MDPDALLWGMSCHGLGRTESNRTLLLPWPHLVQHRRPKPGLSPLSPTHLSLPRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 822878 - protein, 198 aa, Homo sapiens; identical to SEQ ID NO: 822870

SEQ ID NO: 822879 - protein, 102 aa, Homo sapiens
RGRSKDSCKRWAARRVHAGNIKSYPGLTSYLVRVVSTNYNQHAMVFFKKVSQNREYFKITLYGRTKELTSELKENFIRFSKSLGLPENHIVFPVPIDQCIDG

SEQ ID NO: 822880 - protein, 89 aa, Homo sapiens
VPFLRKAHLSYPGLTSYLVRVVSTNYNQHAMVFFKKVSQNREYFKITLYGRTKELTSELKENFIRFSKSLGLPENHIVFPVPIDQCIDG

SEQ ID NO: 822881 - protein, 109 aa, Homo sapiens
MKSELESEYFRSRLLGARLSSRWAYIEELPWEYPYVYLVRVVSTNYNQHAMVFFKKVSQNREYFKITLYGRTKELTSELKENFIRFSKSLGLPENHIVFPVPIDQCIDG

SEQ ID NO: 822882 - protein, 117 aa, Homo sapiens
SLATSSSTPARPSSHHSACFLGPEIMPLGLLWLGLALLGALHAQAQDSTSDLIPAPPLSKVPLQQNFQDNQFQGKWYVVGLAGNAILREDKDPQKMYATIYELKEDKSYNVTSVLFR

SEQ ID NO: 822883 - protein, 121 aa, Homo sapiens
SLATSSSTPARPSSHHSACFLGPEIMPLGLLWLGLALLGALHAQAQDSTSDLIPAPPLSKVPLQQNFQDNQVRADISWGCESQTDVTGKGWPKLRDPVVHLAVLPGIHLCSSFLCSLEQRL

SEQ ID NO: 822884 - protein, 212 aa, Homo sapiens
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 822885 - protein, 172 aa, Homo sapiens
MKPPSSIQTSCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 822886 - protein, 206 aa, Homo sapiens [sequence omitted]

SEQ ID NO: 822887 - protein, 178 aa, Homo sapiens
MKSLLKMNRLQFIYHGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 822888 - protein, 212 aa, Homo sapiens; identical to SEQ ID NO: 822884

SEQ ID NO: 822889 - protein, 203 aa, Homo sapiens
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKDLPTSQFLPQSVLGMDPLT

SEQ ID NO: 822890 - protein, 148 aa, Homo sapiens
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHSCLSPTIPV

SEQ ID NO: 822891 - protein, 103 aa, Homo sapiens [sequence omitted]

SEQ ID NO: 822892 - protein, 207 aa, Homo sapiens
MSCTIEKILTDAKTLLERLREHDAAAESLVDQSAALHRRVAAMREAGTALPDQYQEDASDMKDMSKYKPHILLSQENTQIRDLQQENRELWISLEEHQDALELIMSKYRKQMLQLMVAKKAVDAEPVLKAHQSHSAEIESQIDRICEMGEVMRKAVQVDDDQFCKIQEKLAQLELENKELRELLSISSESLQARKENSMDTASQAIK

SEQ ID NO: 822893 - protein, 141 aa, Homo sapiens
MSCTIEKILTDAKTLLERLREHDAAAESLVDQSAALHRRVAAMREAGTALPDQYQEDASDMKDMSKYKPHILLSQENTQIRDLQQENRELWISLEEHQDALELIMSKYRKQMLQLMVAKKAVDAEPVLKAHQSHSAVRNFE

SEQ ID NO: 822894 - protein, 207 aa, Homo sapiens; identical to SEQ ID NO: 822892

SEQ ID NO: 822895 - protein, 207 aa, Homo sapiens; identical to SEQ ID NO: 822892

SEQ ID NO: 822896 - protein, 103 aa, Homo sapiens [sequence omitted]

SEQ ID NO: 822897 - protein, 163 aa, Homo sapiens [sequence omitted]

SEQ ID NO: 822898 - protein, 169 aa, Homo sapiens
MSCTIEKILTDAKTLLERLREHDAAAESLVDQSAALHRRVAAMREAGTALPDQYQEDASDMKDMSKYKPHILLSQENTQIRDLQQENRELWISLEEHQDALELIMSKYRKQMLQLMVAKKAVDAEPVLKAHQSHSALENKELRELLSISSESLQARKENSMDTASQAIK

SEQ ID NO: 822899 - protein, 475 aa, Homo sapiens
QLRAHLDPRKARAAPIPAGRAALGASRLPPCPSRPPAARRPAPCRDGCRIAGTNSAAEAKLFPLPGSGIPTGKMVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQGRRGLRQDTGDSTGRTWGGEGALTHRPPAGTGGFLRAVSEGLATLHYDVNECELYGQEGRPRLCMHACVNTPGSYRCTCPGGYRTLADGKSCEDVDECVGLQPVCPQGTTCINTGGSFQCVSPECPEGSGNVSYVKTSPFNLEGPQTLEVDVDMSEYLDRSFQANHVSKVTIFVSPYDF

SEQ ID NO: 822900 - protein, 475 aa, Homo sapiens; identical to SEQ ID NO: 822899

SEQ ID NO: 822901 - protein, 456 aa, Homo sapiens
QLRAHLDPRKARAAPIPAGRAALGASRLPPCPSRPPAARRPAPCRDGCRIAGTNSAAEAKLFPLPGSGIPTGKMVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQGRRGLRQDTGDSTGRTWGGEGALTHRPPAGTGGFLRAVSEGLATLHYDVNECELYGQEGRPRLCMHACVNTPGSYRCTCPGGYRTLADGKSCEDVDECVGLQPVCPQGTTCINTGGSFQCVSPECPEGSGNVSYVKTSPFLTEVFWRASLPALRFLLQLG

SEQ ID NO: 822902 - protein, 447 aa, Homo sapiens
QLRAHLDPRKARAAPIPAGRAALGASRLPPCPSRPPAARRPAPCRDGCRIAGTNSAAEAKLFPLPGSGIPTGKMVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQGRRGLRQDTGDSTGRTWGGEGALTHRPPAGTGGFLRAVSEGLATLHYDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDS

SEQ ID NO: 822903 - protein, 97 aa, Homo sapiens
MGGGGDVFSPQNCLSKQQLLSAIRQLQQLLKGQETRFAEGIRHMKSRLAALQNSVGRVGPDALPGGSPRRHRWGGSAALEHSPRDAPSWRPLVTPHP

SEQ ID NO: 822904 - protein, 358 aa, Homo sapiens
KYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVQWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQLHVPFHEDASTDT

SEQ ID NO: 822905 - protein, 254 aa, Homo sapiens
KYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVQWPSQVGTLTYVWWYGNNTEVGSPSTCDLGTEAQFTLPEAKEGMKWLMNPRV

SEQ ID NO: 822906 - protein, 103 aa, Homo sapiens
PRQRAARGSRFRPGTNSRSARVQRARLSTGLLAPNDHGFQPASVRPTTMTPNRPPVSNCFSNREAAMTQLTTPLVTGDLRSSTIYGTGATSGSNHPLDRAAAK

SEQ ID NO: 822907 - protein, 103 aa, Homo sapiens; identical to SEQ ID NO: 822906

SEQ ID NO: 822908 - protein, 661 aa, Homo sapiens
REESGAGARPRRRSADSGAAGAGRGGGGEAAGKEEEGESRSRRASMGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETETKYIHLSGPVILW

SEQ ID NO: 822909 - protein, 259 aa, Homo sapiens
MHHWVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 822910 - protein, 259 aa, Homo sapiens; identical to SEQ ID NO: 822909

SEQ ID NO: 822911 - protein, 259 aa, Homo sapiens; identical to SEQ ID NO: 822909

SEQ ID NO: 822912 - protein, 259 aa, Homo sapiens; identical to SEQ ID NO: 822909

SEQ ID NO: 822913 - protein, 259 aa, Homo sapiens; identical to SEQ ID NO: 822909

SEQ ID NO: 822914 - protein, 259 aa, Homo sapiens; identical to SEQ ID NO: 822909

SEQ ID NO: 822915 - protein, 259 aa, Homo sapiens; identical to SEQ ID NO: 822909

SEQ ID NO: 822916 - protein, 259 aa, Homo sapiens; identical to SEQ ID NO: 822909

SEQ ID NO: 822917 - protein, 259 aa, Homo sapiens; identical to SEQ ID NO: 822909

SEQ ID NO: 822918 - protein, 259 aa, Homo sapiens; identical to SEQ ID NO: 822909

SEQ ID NO: 822919 - protein, 259 aa, Homo sapiens; identical to SEQ ID NO: 822909

SEQ ID NO: 822920 - protein, 94 aa, Homo sapiens
MHHWVDGVVLEKVQEDEFRYRMYQTQVSDAGLYRCMVTAWSPVRGSLWREAATSLSNPIEIDFQTSGPIFNASVHSDTPSVIRFAVLYHLRVPS

SEQ ID NO: 822921 - protein, 153 aa, Homo sapiens
MHHWVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPGTSLHPHPFTMLLSVNVSHIIRTVLHRCGLGIGLSIYPLTAWPSTLYSLSV

SEQ ID NO: 822922 - protein, 144 aa, Homo sapiens
MPKNKGKGGKNRRRGKNENESEKRELVFKEDGQEYAQVIKMLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 822923 - protein, 144 aa, Homo sapiens; identical to SEQ ID NO: 822922

SEQ ID NO: 822924 - protein, 144 aa, Homo sapiens; identical to SEQ ID NO: 822922

SEQ ID NO: 822925 - protein, 104 aa, Homo sapiens
MLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 822926 - protein, 35 aa, Homo sapiens
MPKNKGNVRPDPGPRVFSAGFPGPVPEIAGTPAGS

SEQ ID NO: 822927 - protein, 144 aa, Homo sapiens; identical to SEQ ID NO: 822922

SEQ ID NO: 822928 - protein, 144 aa, Homo sapiens; identical to SEQ ID NO: 822922

SEQ ID NO: 822929 - protein, 144 aa, Homo sapiens; identical to SEQ ID NO: 822922

SEQ ID NO: 822930 - protein, 126 aa, Homo sapiens
MPKNKGKGGKNRRRGKNENESEKRELVFKEDGQEYAQVIKMLGNGRLEAMCFDGVKRLCHIRGKLRKKVWINTSDIILVGLRDYQDNKADVILKYNADEARSLKAYGELPEHFDDIGDDDEDIDDI

SEQ ID NO: 822931 - protein, 144 aa, Homo sapiens; identical to SEQ ID NO: 822922

SEQ ID NO: 822932 - protein, 583 aa, Homo sapiens
MAAAAVSESWPELELAERERRRELLLTGPGLEERVRAAGGQLPPRLFTLPLLHYLEVSGCGSLRAPGPGLAQGLPQLHSLVLRRNALGPGLSPELGPLPALRVLDLSGNALEALPPGQGLGPAEPPGLPQLQSLNLSGNRLRELPADLARCAPRLQSLNLTGNCLDSFPAELFRPGALPLLSELAAADNCLRELSPDIAHLASLKTLDLSNNQLSEIPAELADCPKLKEINFRGNKLRDKRLEKMVSGCQTRSILEYLRVGGRGGGKGKGRAEGSEKEESRRKRRERKQRREGGDGEEQDVGDAGRLLLRVLHVSENPVPLTVRVSPEVRDVRPYIVGAVVRGMDLQPGNALKRFLTSQTKLHEDLCEKRTAATLATHELRAVKGPLLYCARPPQDLKIVPLGRKEAKAKELVRQLQLEAEEQRKQKKRQSVSGLHRYLHLLDGNENYPCLVDADGDVISFPPITNSEKTKVKKTTSDLFLEVTSATSLQICKDVMDALILKMAEMKKYTLENKEEGSLSDTEADAVSGQLPDPTTNPSAGKDGPSLLVVEQVRVVDLEGSLKVVYPSKADLATAPPHVTVVR

SEQ ID NO: 822933 - protein, 583 aa, Homo sapiens; identical to SEQ ID NO: 822932

SEQ ID NO: 822934 - protein, 92 aa, Homo sapiens
QVKKVIFYLQKMAEMKKYTLENKEEGSLSDTEADAVSGQLPDPTTNPSAGKDGPSLLVVEQVRVVDLEGSLKVVYPSKADLATAPPHVTVVR

SEQ ID NO: 822935 - protein, 161 aa, Homo sapiens
MWSRHVAQAGVRWLIIGAVPLLISTGAFCPALFLTWAGSLLFRQPGGPPLPGAHHSDDRLSVDTPLAQHTPANSWAHAALLSQPPECWDHRHMPPHPAQCFFYNYAWNLYFFPYRYLHLLDGNENYPCLVDADGDVISFPPITNSEKTKVGWHVCEHGVSS

SEQ ID NO: 822936 - protein, 107 aa, Homo sapiens
SLRQSLLLLPRLEFNGTILAYHNLCLLGSSNSPASGSQVAGITGMCHHTRLIFVFLVETGYLHVGQAGLELLTSGDPPTSASQSAGITGVSRHAWPSSAFIHIFSPK

SEQ ID NO: 822937 - protein, 228 aa, Homo sapiens
LGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALVSAFIFFSCTRNKLPTHSSREHI

SEQ ID NO: 822938 - protein, 390 aa, Homo sapiens
LGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRFPGDAAAAAGGAVKFTVKTTGTNNVCVAMTFLWGWAGVLHRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 822939 - protein, 349 aa, Homo sapiens
LGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 822940 - protein, 183 aa, Homo sapiens
MIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 822941 - protein, 254 aa, Homo sapiens
EVGRVASLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLG

SEQ ID NO: 822942 - protein, 171 aa, Homo sapiens
MYIWLVLFSSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRHLFFIFLNTLFGACGTGL

SEQ ID NO: 822943 - protein, 72 aa, Homo sapiens
CRFDDVVHTQKSPLLLQLHPGNVSLITTPVKHSHVLSIFGPVSSKVVFERYSIKEDCGICLSVPIISLSLDI

SEQ ID NO: 822944 - protein, 91 aa, Homo sapiens
MVTNDGATILKNIGVDNPAAKVLVDMSRVQDDEVGDGTTSVTVLAAELLRHADFELPIPPQAIMRVGEPHQACSEPLESSPPHRPTVPLVI

SEQ ID NO: 822945 - protein, 568 aa, Homo sapiens
EVGRVASLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 822946 - protein, 568 aa, Homo sapiens; identical to SEQ ID NO: 822945

SEQ ID NO: 822947 - protein, 488 aa, Homo sapiens
MDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 822948 - protein, 488 aa, Homo sapiens; identical to SEQ ID NO: 822947

SEQ ID NO: 822949 - protein, 569 aa, Homo sapiens
EVGRVASLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRYPNTFLRKNY

SEQ ID NO: 822950 - protein, 395 aa, Homo sapiens [sequence omitted]

SEQ ID NO: 822951 - protein, 415 aa, Homo sapiens
GDLRVDNIIKAAPRKRVPDHLLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 822952 - protein, 335 aa, Homo sapiens
EVGRVASLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 822953 - protein, 289 aa, Homo sapiens
EVGRVASLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKVCNSTF

SEQ ID NO: 822954 - protein, 263 aa, Homo sapiens
EVGRVASLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGMYECQIQEALIRC

SEQ ID NO: 822955 - protein, 174 aa, Homo sapiens
MDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLG

SEQ ID NO: 822956 - protein, 552 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 822957 - protein, 557 aa, Homo sapiens
MRRLTRRLVLPVFGVLWITVLLFFWVTKRKLEVPTGPEVQTPKVWSLFFKVAGMSPWAPQVPVSPTPPYQRGHLPTGGHLAVCHFPCLLQEAQFHLQTQVFLQVRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 822958 - protein, 762 aa, Homo sapiens
MSMLVVNLDESHLGSLRVGLSVGPALPAHSLRPRAPPGVLGTASDSSLSLLESVSLSVLCMLWQWLAVLCCAVLCMPAVLCCAVGVTHLCACQPAAFSLSVMLCAVHACLPSVILPLPLFLCVCPCTLPAHVLCYLLLAAGDMCAALHVILPAPSKPVILVVRCSPEADVLLCQLNSLAPAKPLTCLWCVCPPCDVSCLLDDVNAGNWGTMRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 822959 - protein, 592 aa, Homo sapiens
MRRLTRRLVLPVFGVLWITVLLFFWVTKRKLEVPTGPEVQTPKLGTYSFLNGCAGHEPLGAPLGCACITLTSFPTNMRASSYEPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 822960 - protein, 519 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 822961 - protein, 510 aa, Homo sapiens
MPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 822962 - protein, 435 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGKYGPSHTPSRSSRRSCACQSSPCSLAPQWFLSFARMEMTDSNGPKLVPTSST

SEQ ID NO: 822963 - protein, 508 aa, Homo sapiens [sequence omitted]

SEQ ID NO: 822964 - protein, 552 aa, Homo sapiens; identical to SEQ ID NO: 822956

SEQ ID NO: 822965 - protein, 556 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQANGTTGSSGQRPAGGTSEIWVQKPRVRNRGMLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAQALVQYLEEPLTQVAAS

SEQ ID NO: 822966 - protein, 74 aa, Homo sapiens
MIIAYWDPWCFLPACANHTRKCGCIPRVVASWILNKPSWSLSPQVWAFTYTQQILQEELCLSVITLFPGAPVVL

SEQ ID NO: 822967 - protein, 412 aa, Homo sapiens
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLETAFPRYDSAMSIMTEIGNRLGQVQALLGVAKCWVARKALDKALDAIERAQDLAEEVGNKLSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 822968 - protein, 353 aa, Homo sapiens
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLELSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 822969 - protein, 420 aa, Homo sapiens
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLEVKVTGMQGLGAGGRGTGLIQPDSIPHLALQTAFPRYDSAMSIMTEIGNRLGQVQALLGVAKCWVARKALDKVPAEQRDPELSQLPPLIHEAWLCMTPGSRRGLPPRHSCSFSTARQRPIYSWGSCQVVLTIAKALGPAQGCSPGPSSPPCLFVLCSL

SEQ ID NO: 822970 - protein, 208 aa, Homo sapiens
HSSGGGRGVGLSHWPPSQESMKIALQHGDRPLQALCLLCFADIHRSRGDLEVEVTGMQGLGAGGRGTGLIQPDSIPHLALQTAFPRYDSAMSIMTEIGNRLGQVQALLGVAKCWVARKALDKVPAEQRDPELSQLPPLIHEAWLCMTPGSRRGLPPRHSCSFSTARQRPIYSWGSCQVVLTIAKALGPAQGCSPGPSSPPCLFVLCSL

SEQ ID NO: 822971 - protein, 69 aa, Homo sapiens
PVSKACQTALPAALAYAPFQALDAIERAQDLAEEVGNKVRLDSVSWIWGQGPKWGTWVWGRAFLSLLTS

SEQ ID NO: 822972 - protein, 116 aa, Homo sapiens
MPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPSTAAAALPL

SEQ ID NO: 822973 - protein, 116 aa, Homo sapiens; identical to SEQ ID NO: 822972

SEQ ID NO: 822974 - protein, 116 aa, Homo sapiens; identical to SEQ ID NO: 822972

SEQ ID NO: 822975 - protein, 116 aa, Homo sapiens; identical to SEQ ID NO: 822972

SEQ ID NO: 822976 - protein, 116 aa, Homo sapiens; identical to SEQ ID NO: 822972

SEQ ID NO: 822977 - protein, 116 aa, Homo sapiens; identical to SEQ ID NO: 822972

SEQ ID NO: 822978 - protein, 116 aa, Homo sapiens; identical to SEQ ID NO: 822972

SEQ ID NO: 822979 - protein, 116 aa, Homo sapiens; identical to SEQ ID NO: 822972

SEQ ID NO: 822980 - protein, 133 aa, Homo sapiens
TLEDPPTRRSSNRRVPRMPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPSTAAAALPL

SEQ ID NO: 822981 - protein, 108 aa, Homo sapiens
MLSRMAPRPRAPQMRAAPRPAPVAQPPAAAPPSAVGSSAAAPRQPGLMAQMATTAAGVAVGSAVGHTLGHAITGGFSGGSNAEPARPDITYQEPQGTQPSTAAAALPL

SEQ ID NO: 822982 - protein, 116 aa, Homo sapiens; identical to SEQ ID NO: 822972

SEQ ID NO: 822983 - protein, 116 aa, Homo sapiens
MVALRWLSHVRRPSRRVPRMPRGSRSRTSRMAPPASRAPQMRAAPRPAPVAQPGLMAQMATTAAGVAVGSAVGHTLGHAITGGFSGGSNAEPARPDITYQEPQGTQPSTAAAALPL

SEQ ID NO: 822984 - protein, 110 aa, Homo sapiens
MPRGSRSRTSRMAPPASRAPQMRAAPRPAPVAQPPAAAPPSSVEEVMLSLRGLTSLTRSLREPSPAQQQQPCLYEIKQFPGSVPRTRVTSRLCEGFNEVLKQCRLANGLA

SEQ ID NO: 822985 - protein, 69 aa, Homo sapiens
QVQGVDREGRGVPVTSCSSNELQACGDDGERKFSACVLVGCALRPAPPPIFRSPQKSLSSSVVVTRPEA

SEQ ID NO: 822986 - protein, 51 aa, Homo sapiens
MANCSLDFLGSSYSTTSASRVTGTTGMRHLCTTLGDFILFYILAETGSHYV

SEQ ID NO: 822987 - protein, 116 aa, Homo sapiens; identical to SEQ ID NO: 822972

SEQ ID NO: 822988 - protein, 116 aa, Homo sapiens; identical to SEQ ID NO: 822972

SEQ ID NO: 822989 - protein, 116 aa, Homo sapiens; identical to SEQ ID NO: 822972

SEQ ID NO: 822990 - protein, 116 aa, Homo sapiens; identical to SEQ ID NO: 822972

SEQ ID NO: 822991 - protein, 116 aa, Homo sapiens; identical to SEQ ID NO: 822972

SEQ ID NO: 822992 - protein, 130 aa, Homo sapiens
MRLVQIRQSRRVPRMPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPSTAAAALPL

SEQ ID NO: 822993 - protein, 112 aa, Homo sapiens
MTQREAAGGGELSRAPQMRAAPRPAPVAQPPAAAPPSAVGSSAAAPRQPGLMAQMATTAAGVAVGSAVGHTLGHAITGGFSGGSNAEPARPDITYQEPQGTQPSTAAAALPL

SEQ ID NO: 822994 - protein, 130 aa, Homo sapiens; identical to SEQ ID NO: 822992

SEQ ID NO: 822995 - protein, 98 aa, Homo sapiens
GLRQWEFGTRYMAVLSGVRWLTRALVSAGNPGAWRGLMAQMATTAAGVAVGSAVGHTLGHAITGGFSGGSNAEPARPDITYQEPQGTQPSTAAAALPL

SEQ ID NO: 822996 - protein, 116 aa, Homo sapiens; identical to SEQ ID NO: 822972

SEQ ID NO: 822997 - protein, 116 aa, Homo sapiens; identical to SEQ ID NO: 822972

SEQ ID NO: 822998 - protein, 932 aa, Homo sapiens
PGYTAQSGGGAGVQASEEVNANLSERCGALFRMSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDVKPKAEGQASENKWSHLLVQREKMKELKKGRNSKFRDNSEKCVLEKWKRNQFSQDYNSNKIIKEPLGSRRQKISFKIPIKSRDTLQKLVEENVFNIDSNNSKTKQEEREYLESSQVSLNVTRQKTEHLLSDFTYKRTVHEWKRKHHYDHQESNDSHSRENLTQSFEAPCCSVSSESIQDADQEMQIVEELHAARVGKSVDLPGELMSMEIDLEDDVHSSSANNTSDRKLLIVIDTNILMNHLKFVRILKTTEVPGFDKLVLIIPWVVMQELDRMKEGKLLKRAQHKAIPAVHFINDSLKNQDRKLWGQSIQLASQKHYGLSDENNDDRVLKCCLQHQELFPCSFVILCTDDRNLRNKGLISGVKSLSKEELSAELLHLSLNTDVCHQPCIPKQQLKAETTPLKESYKEESTNSGLSILLESIVSDLEKSLGTGLSSILETEMKIAFGNLWMEILYLKPPWTLLHLLQCFKKHWLAVFGLVMEKNLLLTIESLYKNLRKANKAVDFTTVKFLLQDSRSLLHAFSTRSNYDGILPQTFAQVNNLLQTFAEVKTKLKPNSSENTVTKKQEGTSLKNSHNQEITVFSSSHLPQPSRHQEIWSILESVWITIYQNSTDVFQRLGSNSALTTSNIASFEEAFICLQKLMAAVRDILEGIQRILAPNSNYQDVETLYNFLIKYEVNKNVKFTAQEIYDCVSQTEYREKLTIGCRQLVEMEYTMQQCNASVYMEAKNRGWCEDMLNYRI

SEQ ID NO: 822999 - protein, 900 aa, Homo sapiens
MSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDVKPKAEGQASENKWSHLLVQREKMKELKKGRNSKFRDNSEKCVLEKWKRNQFSQDYNSNKIIKEPLGSRRQKISFKIPIKSRDTLQKLVEENVFNIDSNNSKTKQEEREYLESSQVSLNVTRQKTEHLLSDFTYKRTVHEWKRKHHYDHQESNDSHSRENLTQSFEAPCCSVSSESIQDADQEMQIVEELHAARVGKSVDLPGELMSMEIDLEDDVHSSSANNTSDRKLLIVIDTNILMNHLKFVRILKTTEVPGFDKLVLIIPWVVMQELDRMKEGKLLKRAQHKAIPAVHFINDSLKNQDRKLWGQSIQLASQKHYGLSDENNDDRVLKCCLQHQELFPCSFVILCTDDRNLRNKGLISGVKSLSKEELSAELLHLSLNTDVCHQPCIPKQQLKAETTPLKESYKEESTNSGLSILLESIVSDLEKSLGTGLSSILETEMKIAFGNLWMEILYLKPPWTLLHLLQCFKKHWLAVFGLVMEKNLLLTIESLYKNLRKANKAVDFTTVKFLLQDSRSLLHAFSTRSNYDGILPQTFAQVNNLLQTFAEVKTKLKPNSSENTVTKKQEGTSLKNSHNQEITVFSSSHLPQPSRHQEIWSILESVWITIYQNSTDVFQRLGSNSALTTSNIASFEEAFICLQKLMAAVRDILEGIQRILAPNSNYQDVETLYNFLIKYEVNKNVKFTAQEIYDCVSQTEYREKLTIGCRQLVEMEYTMQQCNASVYMEAKNRGWCEDMLNYRI

SEQ ID NO: 823000 - protein, 929 aa, Homo sapiens
RGCGPEPSLAGGSRTDHERQAVTIARTIACPGPQSCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDVKPKAEGQASENKWSHLLVQREKMKELKKGRNSKFRDNSEKCVLEKWKRNQFSQDYNSNKIIKEPLGSRRQKISFKIPIKSRDTLQKLVEENVFNIDSNNSKTKQEEREYLESSQVSLNVTRQKTEHLLSDFTYKRTVHEWKRKHHYDHQESNDSHSRENLTQSFEAPCCSVSSESIQDADQEMQIVEELHAARVGKSVDLPGELMSMEIDLEDDVHSSSANNTSDRKLLIVIDTNILMNHLKFVRILKTTEVPGFDKLVLIIPWVVMQELDRMKEGKLLKRAQHKAIPAVHFINDSLKNQDRKLWGQSIQLASQKHYGLSDENNDDRVLKCCLQHQELFPCSFVILCTDDRNLRNKGLISGVKSLSKEELSAELLHLSLNTDVCHQPCIPKQQLKAETTPLKESYKEESTNSGLSILLESIVSDLEKSLGTGLSSILETEMKIAFGNLWMEILYLKPPWTLLHLLQCFKKHWLAVFGLVMEKNLLLTIESLYKNLRKANKAVDFTTVKFLLQDSRSLLHAFSTRSNYDGILPQTFAQVNNLLQTFAEVKTKLKPNSSENTVTKKQEGTSLKNSHNQEITVFSSSHLPQPSRHQEIWSILESVWITIYQNSTDVFQRLGSNSALTTSNIASFEEAFICLQKLMAAVRDILEGIQRILAPNSNYQDVETLYNFLIKYEVNKNVKFTAQEIYDCVSQTEYREKLTIGCRQLVEMEYTMQQCNASVYMEAKNRGWCEDMLNYRI

SEQ ID NO: 823001 - protein, 932 aa, Homo sapiens; identical to SEQ ID NO: 822998

SEQ ID NO: 823002 - protein, 356 aa, Homo sapiens
PGYTAQSGGGAGVQASEEVNANLSERCGALFRMSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDVKPKAEGQASENKWSHLLVQREKMKELKKGRNSKFRDNSEKCVLEKWKRNQFSQDYNSNKIIKEPLGSRRQKISFKIPIKSRDTLQKLVEENVFNIDSNNSKTKQEEREYLESSQVSLNVTRQKTEHLLSDFTYKRTVHEWKRKHHYDHQESNDSHSRENLTQVR

SEQ ID NO: 823003 - protein, 432 aa, Homo sapiens
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 823004 - protein, 432 aa, Homo sapiens; identical to SEQ ID NO: 823003

SEQ ID NO: 823005 - protein, 277 aa, Homo sapiens [sequence omitted]

SEQ ID NO: 823006 - protein, 414 aa, Homo sapiens
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 823007 - protein, 293 aa, Homo sapiens
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDLGNCCILTKI

SEQ ID NO: 823008 - protein, 285 aa, Homo sapiens
MWKTQSLRKCSGRGRANLAQPTQRLRMVWRRKRKPAGRQQPNPLPHLWRRTPQTRRKSLAYAHIFSPNLCFIQDQESKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLVSCPHNYLNAKEREYVPQLHLCLHHDQGVGRA

SEQ ID NO: 823009 - protein, 355 aa, Homo sapiens
VGFKCGWCHPSEQTLKEKTSEIALVSEKHTNWLKELWLGRSGVNTKFLPDISQSFLKITWPLEDDKETASPTSKKEHSANIPSTAYALEEYVPRERSEASGSDLELSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLVSCPHNYLNAKEREYVPQLHLCLHHDQGVGRA

SEQ ID NO: 823010 - protein, 372 aa, Homo sapiens
VGFKCGWCHPSEQTLKEKTSEIALVSEKHTNWLKELWLGRSGVNTKFLPDISQSFLKITWPLEDDKETASPTSKKEHSANIPSTAYALEEYVPRERSEASGSRPGTLPLSECTKVKRFPFFFSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLVSCPHNYLNAKEREYVPQLHLCLHHDQGVGRA

SEQ ID NO: 823011 - protein, 446 aa, Homo sapiens
MVKKRLPSSDTVFRFETPGSPRKANVEASRSSTDSPSSVFLSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 823012 - protein, 178 aa, Homo sapiens
THVGFKCGWCHPSEQTLKEKTSEIALVSEKHTNWLKELWLGRSGVNTKFLPDISQSFLKITWPLEDDKETASPTSKKEHSANIPSTAYALEEYVPRERSEASGSRPGTVSDRSQTWKNHLGVECGFCGLKGLFGILRTECLHMENVFDCPLGEFSLFIIRVLSKSKNYPTYCNVLRNP

SEQ ID NO: 823013 - protein, 234 aa, Homo sapiens [sequence omitted]

SEQ ID NO: 823014 - protein, 234 aa, Homo sapiens [sequence omitted]

SEQ ID NO: 823015 - protein, 177 aa, Homo sapiens
MKICSLTLLSFLLLAAQVLLVEGKKKVKNGLHSKVVSEQKDTLGNTQIKQKSRPGNKGKFVTKDQANCRWAATEQEEGISLKVECTQLDHEFSCVFAGNPTSCLKLKDERVYWKQVARNLRSQKDICRYSKTAVKTRVCRKDFPESSLKPSTPFCKRCPSCPFQIATSSFEGPLERP

SEQ ID NO: 823016 - protein, 262 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREAERVSKRDDWVQEGMGKRPTVP

SEQ ID NO: 823017 - protein, 261 aa, Homo sapiens
QAARRTAPAAGRGELYCGVLPRSPWFLSERRRQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 823018 - protein, 228 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 823019 - protein, 228 aa, Homo sapiens; identical to SEQ ID NO: 823018

SEQ ID NO: 823020 - protein, 261 aa, Homo sapiens; identical to SEQ ID NO: 823017

SEQ ID NO: 823021 - protein, 261 aa, Homo sapiens; identical to SEQ ID NO: 823017

SEQ ID NO: 823022 - protein, 261 aa, Homo sapiens; identical to SEQ ID NO: 823017

SEQ ID NO: 823023 - protein, 261 aa, Homo sapiens; identical to SEQ ID NO: 823017

SEQ ID NO: 823024 - protein, 261 aa, Homo sapiens; identical to SEQ ID NO: 823017

SEQ ID NO: 823025 - protein, 248 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 823026 - protein, 281 aa, Homo sapiens
QAARRTAPAAGRGELYCGVLPRSPWFLSERRRQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 823027 - protein, 129 aa, Homo sapiens [sequence omitted]

SEQ ID NO: 823028 - protein, 129 aa, Homo sapiens [sequence omitted]

SEQ ID NO: 823029 - protein, 261 aa, Homo sapiens; identical to SEQ ID NO: 823017

SEQ ID NO: 823030 - protein, 235 aa, Homo sapiens
QAARRTAPAAGRGELYCGVLPRSPWFLSERRRQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDGPPLRGSNMDFREPTEEERAQRPRLQLKPRTVATPLNQVANPNSAIFGGARPREEVVQKEQE

SEQ ID NO: 823031 - protein, 205 aa, Homo sapiens
TTNTKEEIRLGTRLGVGDGKWRTSTPTTIGPTAASAAAEGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 823032 - protein, 129 aa, Homo sapiens [sequence omitted]

SEQ ID NO: 823033 - protein, 261 aa, Homo sapiens; identical to SEQ ID NO: 823017

SEQ ID NO: 823034 - protein, 261 aa, Homo sapiens; identical to SEQ ID NO: 823017

SEQ ID NO: 823035 - protein, 261 aa, Homo sapiens; identical to SEQ ID NO: 823017

SEQ ID NO: 823036 - protein, 261 aa, Homo sapiens; identical to SEQ ID NO: 823017

SEQ ID NO: 823037 - protein, 261 aa, Homo sapiens; identical to SEQ ID NO: 823017

SEQ ID NO: 823038 - protein, 261 aa, Homo sapiens; identical to SEQ ID NO: 823017

SEQ ID NO: 823039 - protein, 200 aa, Homo sapiens
QAARRTAPAAGRGELYCGVLPRSPWFLSERRRQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGQGALGVEGVVLVLHWADCGADAAFPPIPVACVLCGSVPSIGNIMRYCASHLPFSSEPKWV

SEQ ID NO: 823040 - protein, 261 aa, Homo sapiens; identical to SEQ ID NO: 823017

SEQ ID NO: 823041 - protein, 231 aa, Homo sapiens
QAARRTAPAAGRGELYCGVLPRSPWFLSERRRQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFRDGPPLRGSNMDFREPTEEDRTQRPRHPCWYQLD

SEQ ID NO: 823042 - protein, 158 aa, Homo sapiens
QAARRTAPAAGRGELYCGVLPRSPWFLSERRRQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVVVRRVQQQLRPY

SEQ ID NO: 823043 - protein, 93 aa, Homo sapiens
RGSAGGHGSRSQKELPTEPPYTAYVGNLPFNTVQGDIDAIFKDLSIRSVRLVRDKDTDKFKGEFGGFLLYITVKCRGGWEGVLNKNRFVNQRL

SEQ ID NO: 823044 - protein, 59 aa, Homo sapiens
MSKAPIAGSNSTLAQYLELGGYGIIRLKVIAQPLTNTVAYPCLYYPMRHNYNSSIWLEK

SEQ ID NO: 823045 - protein, 31 aa, Homo sapiens
MHLPSQAKPHRYNEGSQCPTAQEILRDLSSS

SEQ ID NO: 823046 - protein, 144 aa, Homo sapiens
TVRKRGAGAGRGLAPLPFVLSHCVALPPQALLLCTLAARGEFGKGPWMPFLLVFEYVRTSPAPPRAGPCPVPRRRRGGHCPSFPLRALGGFPAAPCAAPPPGGVLTPHSGLSPPDRQPQGRRGDARPLPSEGRGLRTRRALPGI

SEQ ID NO: 823047 - protein, 302 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 823048 - protein, 230 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVRSLISAHGRDVSGVLHEAMSSRGTTGNTQVQSPSNATTATGVFPGLTILPST

SEQ ID NO: 823049 - protein, 302 aa, Homo sapiens; identical to SEQ ID NO: 823047

SEQ ID NO: 823050 - protein, 256 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGVFPGLTILPST

SEQ ID NO: 823051 - protein, 228 aa, Homo sapiens
MFPSWPTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGVFPGLTILPST

SEQ ID NO: 823052 - protein, 134 aa, Homo sapiens
THRHTRTHTHTHTHTHTHTHTHTHIHTLTDPHTYTLSCTQLYLKYIRLFFMPCPSQMEEDEEGNQVNSARQTGCLLQHYWNYFPLLPMEIKENGCDVCAGGRQSEGLISLASQCNLIGESSILKLHMCSTNVSF

SEQ ID NO: 823053 - protein, 302 aa, Homo sapiens; identical to SEQ ID NO: 823047

SEQ ID NO: 823054 - protein, 302 aa, Homo sapiens; identical to SEQ ID NO: 823047

SEQ ID NO: 823055 - protein, 172 aa, Homo sapiens
SSLSVRLRGARETQGANHTPVISAHQTRSTTTPPTPDTEHPVMDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMNRRLLPLLG

SEQ ID NO: 823056 - protein, 78 aa, Homo sapiens
VGRRRRGSPTMLIVAAGDDKKGIVDQSQQAYQEAFEISKKEMQPTHPIRLGLALNFSVFYYEILNSPRESLLSCKDSF

SEQ ID NO: 823057 - protein, 68 aa, Homo sapiens
DLEIPVYIDATKKQQMAREYREKIETELRDICNDVLSLLEKFLIPNASQAESKVFYLKMNRRLLPLLG

SEQ ID NO: 823058 - protein, 68 aa, Homo sapiens; identical to SEQ ID NO: 823057

SEQ ID NO: 823059 - protein, 68 aa, Homo sapiens; identical to SEQ ID NO: 823057

SEQ ID NO: 823060 - protein, 68 aa, Homo sapiens; identical to SEQ ID NO: 823057

SEQ ID NO: 823061 - protein, 68 aa, Homo sapiens; identical to SEQ ID NO: 823057

SEQ ID NO: 823062 - protein, 68 aa, Homo sapiens; identical to SEQ ID NO: 823057

SEQ ID NO: 823063 - protein, 68 aa, Homo sapiens; identical to SEQ ID NO: 823057

SEQ ID NO: 823064 - protein, 68 aa, Homo sapiens; identical to SEQ ID NO: 823057

SEQ ID NO: 823065 - protein, 68 aa, Homo sapiens; identical to SEQ ID NO: 823057

SEQ ID NO: 823066 - protein, 68 aa, Homo sapiens; identical to SEQ ID NO: 823057

SEQ ID NO: 823067 - protein, 68 aa, Homo sapiens; identical to SEQ ID NO: 823057

SEQ ID NO: 823068 - protein, 68 aa, Homo sapiens; identical to SEQ ID NO: 823057

SEQ ID NO: 823069 - protein, 68 aa, Homo sapiens; identical to SEQ ID NO: 823057

SEQ ID NO: 823070 - protein, 68 aa, Homo sapiens; identical to SEQ ID NO: 823057

SEQ ID NO: 823071 - protein, 68 aa, Homo sapiens; identical to SEQ ID NO: 823057

SEQ ID NO: 823072 - protein, 68 aa, Homo sapiens; identical to SEQ ID NO: 823057

SEQ ID NO: 823073 - protein, 68 aa, Homo sapiens; identical to SEQ ID NO: 823057

SEQ ID NO: 823074 - protein, 68 aa, Homo sapiens; identical to SEQ ID NO: 823057

SEQ ID NO: 823075 - protein, 68 aa, Homo sapiens; identical to SEQ ID NO: 823057

SEQ ID NO: 823076 - protein, 68 aa, Homo sapiens; identical to SEQ ID NO: 823057

SEQ ID NO: 823077 - protein, 68 aa, Homo sapiens; identical to SEQ ID NO: 823057

SEQ ID NO: 823078 - protein, 68 aa, Homo sapiens; identical to SEQ ID NO: 823057

SEQ ID NO: 823079 - protein, 68 aa, Homo sapiens; identical to SEQ ID NO: 823057

SEQ ID NO: 823080 - protein, 68 aa, Homo sapiens; identical to SEQ ID NO: 823057

SEQ ID NO: 823081 - protein, 68 aa, Homo sapiens; identical to SEQ ID NO: 823057

SEQ ID NO: 823082 - protein, 68 aa, Homo sapiens; identical to SEQ ID NO: 823057

SEQ ID NO: 823083 - protein, 68 aa, Homo sapiens; identical to SEQ ID NO: 823057

SEQ ID NO: 823084 - protein, 68 aa, Homo sapiens; identical to SEQ ID NO: 823057

SEQ ID NO: 823085 - protein, 68 aa, Homo sapiens; identical to SEQ ID NO: 823057

SEQ ID NO: 823086 - protein, 68 aa, Homo sapiens; identical to SEQ ID NO: 823057

SEQ ID NO: 823087 - protein, 68 aa, Homo sapiens; identical to SEQ ID NO: 823057

SEQ ID NO: 823088 - protein, 68 aa, Homo sapiens; identical to SEQ ID NO: 823057

SEQ ID NO: 823089 - protein, 68 aa, Homo sapiens; identical to SEQ ID NO: 823057

SEQ ID NO: 823090 - protein, 68 aa, Homo sapiens; identical to SEQ ID NO: 823057

SEQ ID NO: 823091 - protein, 68 aa, Homo sapiens; identical to SEQ ID NO: 823057

SEQ ID NO: 823092 - protein, 68 aa, Homo sapiens; identical to SEQ ID NO: 823057

SEQ ID NO: 823093 - protein, 68 aa, Homo sapiens; identical to SEQ ID NO: 823057

SEQ ID NO: 823094 - protein, 68 aa, Homo sapiens; identical to SEQ ID NO: 823057

SEQ ID NO: 823095 - protein, 68 aa, Homo sapiens; identical to SEQ ID NO: 823057

SEQ ID NO: 823096 - protein, 68 aa, Homo sapiens; identical to SEQ ID NO: 823057

SEQ ID NO: 823097 - protein, 68 aa, Homo sapiens; identical to SEQ ID NO: 823057

SEQ ID NO: 823098 - protein, 68 aa, Homo sapiens; identical to SEQ ID NO: 823057

SEQ ID NO: 823099 - protein, 568 aa, Homo sapiens
MASSCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 823100 - protein, 220 aa, Homo sapiens
MRRTHTTNHAIQRQKHNWPDAHEGASGDAEAAEREERRDANREKVRASAHEGRGDDTSSGNRSQGREGKREPDNADNNDHTQATHRRLREEHTTQEQNMQQRRRADGERERAANEQTARRPHTRRRSKHPQAQAKRAESRGTRRSSTNEQSHRHTTEAAQRERRAAQRRHPQHTETKQTARRLAVRAARARTRERARARHQTERQVTERRDQTEASTQPP

SEQ ID NO: 823101 - protein, 568 aa, Homo sapiens; identical to SEQ ID NO: 823099

SEQ ID NO: 823102 - protein, 369 aa, Homo sapiens
MKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 823103 - protein, 568 aa, Homo sapiens; identical to SEQ ID NO: 823099

SEQ ID NO: 823104 - protein, 329 aa, Homo sapiens
GAAYYYYCSEFKLLTMYGAMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 823105 - protein, 520 aa, Homo sapiens
MASSCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQIVNLIEETGHFHITNTTFDFDLCSLDKTTVRKLQSYLETSGTS

SEQ ID NO: 823106 - protein, 162 aa, Homo sapiens
MKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 823107 - protein, 162 aa, Homo sapiens; identical to SEQ ID NO: 823106

SEQ ID NO: 823108 - protein, 74 aa, Homo sapiens
GGHSTGRRHIQYTALLHNRGMTLRERHILQQIVNLIEETGHFHITNTTFDFDLCSLDKTTVRKLQSYLETSGTS

SEQ ID NO: 823109 - protein, 684 aa, Homo sapiens
QDGGGRGPGCCSGRRVRGGGGPGARGPRPPRPPSSFLCSCGWGGIPSLHNMEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPTPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 823110 - protein, 662 aa, Homo sapiens
QDGGGRGPGCCSGRRVRGGGGPGARGPRPPRPPSSFLCSCGWGGIPSLHNMEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPTPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSSRRVWSPPRVHKVEMGFGGGGGAN

SEQ ID NO: 823111 - protein, 130 aa, Homo sapiens
KARYKRWEKLQIKRKKRHYIKALIATDYLPTTQMVFIKYMWDKKKFRKGTTVSPSPAHSTTQPLPPKVFPELNPSFPSDGYTEAPAPQSRLHMEGGRGGVLNILQSQGQGSGGCSLCLKSVFVLSWRQGL

SEQ ID NO: 823112 - protein, 208 aa, Homo sapiens
MAFRQPAYKNRLCLQFKQLIQTQKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESVLLLGGPL

SEQ ID NO: 823113 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823114 - protein, 559 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823115 - protein, 503 aa, Homo sapiens
KVDTYRIPVDDQHMVPVLNALDSMQQIECSVSGRRKRSTEAVDRPSTAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823116 - protein, 300 aa, Homo sapiens
DPPFGVLADDKRKMPFTEKIMAAPEQADKMKAIVEKHQKQMVRAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823117 - protein, 241 aa, Homo sapiens
MAFRQPAYKNRLCLQFKQLIQTQKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823118 - protein, 577 aa, Homo sapiens; identical to SEQ ID NO: 823113

SEQ ID NO: 823119 - protein, 577 aa, Homo sapiens; identical to SEQ ID NO: 823113

SEQ ID NO: 823120 - protein, 577 aa, Homo sapiens; identical to SEQ ID NO: 823113

SEQ ID NO: 823121 - protein, 127 aa, Homo sapiens
MVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823122 - protein, 127 aa, Homo sapiens; identical to SEQ ID NO: 823121

SEQ ID NO: 823123 - protein, 145 aa, Homo sapiens
TIAMIRSSSFPSLAESAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823124 - protein, 116 aa, Homo sapiens
GAEPDEFFEEDNMLSMGKEDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 823125 - protein, 577 aa, Homo sapiens; identical to SEQ ID NO: 823113

SEQ ID NO: 823126 - protein, 577 aa, Homo sapiens; identical to SEQ ID NO: 823113

SEQ ID NO: 823127 - protein, 577 aa, Homo sapiens; identical to SEQ ID NO: 823113

SEQ ID NO: 823128 - protein, 577 aa, Homo sapiens; identical to SEQ ID NO: 823113

SEQ ID NO: 823129 - protein, 577 aa, Homo sapiens; identical to SEQ ID NO: 823113

SEQ ID NO: 823130 - protein, 577 aa, Homo sapiens; identical to SEQ ID NO: 823113

SEQ ID NO: 823131 - protein, 577 aa, Homo sapiens; identical to SEQ ID NO: 823113

SEQ ID NO: 823132 - protein, 577 aa, Homo sapiens; identical to SEQ ID NO: 823113

SEQ ID NO: 823133 - protein, 527 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKQELQAMQMELQSPEYKLSKLRTSTIMTDYNPNYCFAGKTSSISDLKEVPRKNITLIRGLGHGAFGEVYEGQVSGMPNDP

SEQ ID NO: 823134 - protein, 557 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAIAGKLTNDRQRDTLADDTDDTRRHDLTPGRHGRTLTGRRLTRRLDGHTTYRKRLHEQRTWTRTTDTRYGTLDTYDARTPDTRAHETTADTQPGPQREDVNEQLEDGPKELAFDVDRALREDPRTQKNITGTTHGHYENNAQGRLTRLEVLPHAWDSIGPQEQHRQGTTVDGLVEEMGTASKGPNMGTRDRTLGRKNPSWIGRLEQDLGAMRTHPFHSWAHGLGRSTMARQGWTQRD

SEQ ID NO: 823135 - protein, 153 aa, Homo sapiens [sequence omitted]

SEQ ID NO: 823136 - protein, 326 aa, Homo sapiens
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDADEGILWQMFGPFGAVTNVKVIRDFNTNKCKGFGFVTMTNYEEAAMAIASLNGYRLGDKILQVSFKTNKSHK

SEQ ID NO: 823137 - protein, 326 aa, Homo sapiens; identical to SEQ ID NO: 823136

SEQ ID NO: 823138 - protein, 326 aa, Homo sapiens; identical to SEQ ID NO: 823136

SEQ ID NO: 823139 - protein, 326 aa, Homo sapiens; identical to SEQ ID NO: 823136

SEQ ID NO: 823140 - protein, 326 aa, Homo sapiens; identical to SEQ ID NO: 823136

SEQ ID NO: 823141 - protein, 210 aa, Homo sapiens
MTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDADEGILWQMFGPFGAVTNVKVIRDFNTNKCKGFGFVTMTNYEEAAMAIASLNGYRLGDKILQVSFKTNKSHK

SEQ ID NO: 823142 - protein, 231 aa, Homo sapiens
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRWVGRVCAPESHT

SEQ ID NO: 823143 - protein, 153 aa, Homo sapiens
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTVIPQTRTAPK

SEQ ID NO: 823144 - protein, 229 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 823145 - protein, 229 aa, Homo sapiens; identical to SEQ ID NO: 823144

SEQ ID NO: 823146 - protein, 95 aa, Homo sapiens
MAALFLTTNIQNGSRTLAPWVLALLKKVAMPSTLPGERSPCSQAKHQYSVLGKCWAAPMVDTTSPQDIVDMAKDPQGIRWRNLSLAKKKNSKNEQ

SEQ ID NO: 823147 - protein, 133 aa, Homo sapiens
QHGGREARSRCQGGEGAQAAGREGGTKTSKNKAKPPWPTLLSPFIPLFPALYTNGIRSLHKEKNPYIQLSLLSSSRSRPDTERQFRTPGTQQEVLNSVWHGNASLERWPHSFLDYNIQKESTLHLVLRLRGGC

SEQ ID NO: 823148 - protein, 133 aa, Homo sapiens; identical to SEQ ID NO: 823147

SEQ ID NO: 823149 - protein, 111 aa, Homo sapiens
MAALFLTTSIQNGSRTLAPWVLALLKKVAMPSTLPGERSPCSQAKHQYSVLGKCWAAPMVDTTSPQDIVDMAKDPQGMAERANWAAEGKGGTWKNQRGRRAAEGKKKKNKR

SEQ ID NO: 823150 - protein, 50 aa, Homo sapiens
MQIFVKTLTGKTITLEVEPSDTIEAYSWRQQLKNGDSSDTHQGATLLACV

SEQ ID NO: 823151 - protein, 229 aa, Homo sapiens; identical to SEQ ID NO: 823144

SEQ ID NO: 823152 - protein, 229 aa, Homo sapiens; identical to SEQ ID NO: 823144

SEQ ID NO: 823153 - protein, 229 aa, Homo sapiens; identical to SEQ ID NO: 823144

SEQ ID NO: 823154 - protein, 229 aa, Homo sapiens; identical to SEQ ID NO: 823144

SEQ ID NO: 823155 - protein, 229 aa, Homo sapiens; identical to SEQ ID NO: 823144

SEQ ID NO: 823156 - protein, 115 aa, Homo sapiens
MVVNKKEKNEKKKNWGGGWALGKEGFKTHIGVGGGGPKRDRSRHGPPNTVTQRENRGQRPKGPGTSHEGKKPPGGHTADGFEHTSQRRGPDGNQRETNTRGVRDARNKCRPGGGN

SEQ ID NO: 823157 - protein, 229 aa, Homo sapiens; identical to SEQ ID NO: 823144

SEQ ID NO: 823158 - protein, 170 aa, Homo sapiens
MAALFLTTSIQNGSRTLAPWVLALLKKVAMPSTLPGERSPCSQAKHQYSVLGKCWAAPMVDTTSPQDIVDMAKDPQGIHRKAVPHTRDPARGLHFFWPRAKARLGEKNWGRKLLFPWNLNKTFPRKGSSEPLEPWVPWPALGRGWAGLIPSSPIVPISGKVAPQDGTWCI

SEQ ID NO: 823159 - protein, 83 aa, Homo sapiens
AGVSRAFEVKMQIFVKTLTGKTITLEVEPSDTIENVKAKIQDKEGIPPDQQRLIFAGKQLEDGRTLSDYNIQKGVDPAPGSCV

SEQ ID NO: 823160 - protein, 84 aa, Homo sapiens
DAWVDPRVRVKMQIFVKTLTGKTITLEVEPSDTIENVKAKIQDKEGIPPDQQRLIFAGKQLEDGRTLSDYNIQKGVDPAPGSCV

SEQ ID NO: 823161 - protein, 90 aa, Homo sapiens
IVDSKRIPRFIIGGGVKMQIFVKTLTGKTITLEVEPSDTIENVKAKIQDKEGIPPDQQRLIFAGKQLEDGRTLSDYNIQKGVDPAPGSCV

SEQ ID NO: 823162 - protein, 97 aa, Homo sapiens
WGLIFAEGVRGLHLKDPGIRYQVKMQIFVKTLTGKTITLEVEPSDTIENVKAKIQDKEGIPPDQQRLIFAGKQLEDGRTLSDYNIQKGVDPAPGSCV

SEQ ID NO: 823163 - protein, 70 aa, Homo sapiens
GVQRSRVDFGHLEVEPSDTIENVKAKIQDKEGIPPDQQRLIFAGKQLEDGRTLSDYNIQKGVDPAPGSCV

SEQ ID NO: 823164 - protein, 163 aa, Homo sapiens
MAALFLTTSIQNGSRTLAPWVLALLKKVAMPSTLPGERSPCSQAKHQYSVLGKCWAAPMVDTTSPQDIVDMAKDPQGMQFAHQISRQKGFTPRRGAEPRWGKCAGTSFSWSYEHSRERSSNPGSLDPCALKGVGLFNAFRHGPSAVPRDRPYLWTIAIGRQLS

SEQ ID NO: 823165 - protein, 127 aa, Homo sapiens
MAALFLTTSIQNGSRTLAPWVLALLKKVAMPSTLPGERSPCSQAKHQYSVLGKCWAAPMVDTTSPQDIVDMAKDPQGMAKDARDHSERVPTHEQTESKTLSTAAARARRLGRDANPAAPRCKKRGDP

SEQ ID NO: 823166 - protein, 126 aa, Homo sapiens
MAALFLTTSIQNGSRTLAPWVLALLKKVAMPSTLPGERSPCSQAKHQYSVLGKCWAAPMVDTTSPQDIVDMAKDPQGIELAESLVQAGTVPGSWHHSIDQDQLSTTEAEEQPCGQGAGCFELSGAV

SEQ ID NO: 823167 - protein, 176 aa, Homo sapiens
MAALFLTTNIQNGSRTLAPWVLALLKKVAMPSTLPGERSPCSQAKHQYVIPVKLDAHVTIQSTNCEMADSTDYTDTVSPLPGSQAVSATIFGTAKLAWKEWPALHFWTILVREAQSTRVTWSPCRRDGGGIMAGVLSVSNERLQPGDAPCHRPVYGLEPMVHSRSQNAAMAKHPMI

SEQ ID NO: 823168 - protein, 76 aa, Homo sapiens
MVTIQSKHCELAKIPGYTRRQSASPGSIELAESLVQAGTVPGSWHHSIDQDQLSTTEAEEQPCGQGAGCFELSGAV

SEQ ID NO: 823169 - protein, 33 aa, Homo sapiens
MHAAHLSHLAIRHRRGLNYWAGLQTRKGNPAYP

SEQ ID NO: 823170 - protein, 96 aa, Homo sapiens
GRYYYYIYPRSTTASLERAGEPQWWTPPVRKTLLTWPKIPKGYTEGQFRTPGNQQEVLNTVWHGNASLERWPHSFLDYNIQKESTLHLVLRLRGGC

SEQ ID NO: 823171 - protein, 173 aa, Homo sapiens
SVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKSYEKERQRHIGKPLLGGPFSLTTHTGERKTDKDYLGQWLLIYFGF

SEQ ID NO: 823172 - protein, 333 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 823173 - protein, 333 aa, Homo sapiens; identical to SEQ ID NO: 823172

SEQ ID NO: 823174 - protein, 284 aa, Homo sapiens
MFRAAAPGQLRRAVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 823175 - protein, 70 aa, Homo sapiens
TRRHASLVLDRERLGDWLRRRQLAGHGAAVRPRLRRKRRPCSERRLRGSSGGRDGVSPCYPGWSRTLVLK

SEQ ID NO: 823176 - protein, 333 aa, Homo sapiens; identical to SEQ ID NO: 823172

SEQ ID NO: 823177 - protein, 111 aa, Homo sapiens
MFRAAAPGQLRRAASLLRFQSTLVIAEHANDSLAPITLNTITAATRLGGEVSCLVAGTKCDKVAQDLCKVAGIAGTDTIDFGNSEAVQLHTHLCWSICLRKEPFAQSSSQT

SEQ ID NO: 823178 - protein, 90 aa, Homo sapiens
TRRHASLVLDRERLGDWLRRRQLAGHGAAVRPRLRRKRRPCSERRLRGSSGGRGTDTIDFGNSEAVQLHTHLCWSICLRKEPFAQSSSQT

SEQ ID NO: 823179 - protein, 365 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGVETEVLHVGQAGLEILTSGDPPTSASQSVGITGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 823180 - protein, 229 aa, Homo sapiens
MFRAAAPGQLRRANLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 823181 - protein, 350 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKPPWTALLCPSSHKAALHWKLQLQPLHCHD

SEQ ID NO: 823182 - protein, 310 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 823183 - protein, 311 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIPCSNLRHSGIFCTSL

SEQ ID NO: 823184 - protein, 313 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGVETEVLHVGQAGLEILTSGDPPTSASQSVGITGRGLKSGENFKLLYDLADQLHAAVGASRAAVDAGFVPNDMQVGQTGKIVAPVSIAIKYAV

SEQ ID NO: 823185 - protein, 267 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGTLYCCWNIWSHPTFSWDERQQGHCGHIRPSSIPVGIGIVRFFTES

SEQ ID NO: 823186 - protein, 266 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGVGASRAAVDAGFVPNDMQVGQTGKIVAPRTFIIATELLKLRGTGL

SEQ ID NO: 823187 - protein, 75 aa, Homo sapiens
VGPARAGALCISLRELYIAVGISGAIQHLAGMKDSKTIVAINKDPEAPIFQVADYGIVADLFKVVPEMTEILKKK

SEQ ID NO: 823188 - protein, 90 aa, Homo sapiens; identical to SEQ ID NO: 823178

SEQ ID NO: 823189 - protein, 180 aa, Homo sapiens
KKVVNPLFEKRPKNFGIGQDIQPKRDLTCFVKWPRYIRLQWQRSILYKQLKVPPAINQFTQALEGQTATQLLKLAHKYRPETKQEKKLEAVGPGRVVGKGDLPMKRLPVFRAGVNTVTTFVDNKKAPLVVTTHDMDPIELTVFLPVLCHKMGATCCIIKGKARLGCLVHRKTYTTVDFTQ

SEQ ID NO: 823190 - protein, 73 aa, Homo sapiens
WAEAARLVLENYSDAPMTPKQILQVIEAEGLKEMRSGTSPLACLNAMLHSNSRGGEGLFYKLPGRISLFTLKV

SEQ ID NO: 823191 - protein, 1374 aa, Homo sapiens
MLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 823192 - protein, 1537 aa, Homo sapiens
MGVVNFVFRASEDLQVLENYSDAPMTPKQILQVIEAEGLKEMRSGTSPLACLNAMLHSNSRGGEGLFYKLPGRISLFTLKKDALQWSRHPATVEGEEPEDTADVESCGSNEASTVSGENDVSLDETSSNASCSTESQSRPLSNPRDSYRASSQANKQKKKTGVMLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 823193 - protein, 1369 aa, Homo sapiens
MARLGDTFDQWNAVPSGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 823194 - protein, 1290 aa, Homo sapiens
MLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVRPVATLSPGEARAPLESVRQIYSEHNYCRLYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 823195 - protein, 1374 aa, Homo sapiens; identical to SEQ ID NO: 823191

SEQ ID NO: 823196 - protein, 1374 aa, Homo sapiens; identical to SEQ ID NO: 823191

SEQ ID NO: 823197 - protein, 1374 aa, Homo sapiens; identical to SEQ ID NO: 823191

SEQ ID NO: 823198 - protein, 1111 aa, Homo sapiens
MLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPIPSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDRIQMLLQERAQEILLPREHLVSHLQM

SEQ ID NO: 823199 - protein, 1374 aa, Homo sapiens; identical to SEQ ID NO: 823191

SEQ ID NO: 823200 - protein, 1374 aa, Homo sapiens; identical to SEQ ID NO: 823191

SEQ ID NO: 823201 - protein, 1374 aa, Homo sapiens; identical to SEQ ID NO: 823191

SEQ ID NO: 823202 - protein, 282 aa, Homo sapiens
MLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQSKLWCEPQCITFLANVH

SEQ ID NO: 823203 - protein, 352 aa, Homo sapiens
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLWKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 823204 - protein, 352 aa, Homo sapiens; identical to SEQ ID NO: 823203

SEQ ID NO: 823205 - protein, 352 aa, Homo sapiens; identical to SEQ ID NO: 823203

SEQ ID NO: 823206 - protein, 352 aa, Homo sapiens; identical to SEQ ID NO: 823203

SEQ ID NO: 823207 - protein, 352 aa, Homo sapiens; identical to SEQ ID NO: 823203

SEQ ID NO: 823208 - protein, 175 aa, Homo sapiens
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGQGRH

SEQ ID NO: 823209 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823210 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823211 - protein, 707 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823212 - protein, 705 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823213 - protein, 751 aa, Homo sapiens
MGLTSTWRYGRGPGIGTVTMVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823214 - protein, 787 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEPYSPCYPDPR

SEQ ID NO: 823215 - protein, 684 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRIPPNPSLMSIFRK

SEQ ID NO: 823216 - protein, 769 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 823217 - protein, 795 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEAASLGITRERELPDLPFCNIPCNSELH

SEQ ID NO: 823218 - protein, 768 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 823219 - protein, 820 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEVRTSFSEAPENFQSTSGREGTETHALQCLRSEVTPAISCESPLADTGSKVPN

SEQ ID NO: 823220 - protein, 835 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNERYKLLPCPDKHNKRCKPEERGDLTEAGAAGSSRCVDSRKRVRQEKISTGKTSEIKGQQLESLGGEAV

SEQ ID NO: 823221 - protein, 819 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNESFQSSLKSSSTGIPGWPPGSEVFSEVAFRGILNYDIERPILCAGSKKIYDI

SEQ ID NO: 823222 - protein, 771 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEPLS

SEQ ID NO: 823223 - protein, 768 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNE

SEQ ID NO: 823224 - protein, 680 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 823225 - protein, 254 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVGSQGL

SEQ ID NO: 823226 - protein, 70 aa, Homo sapiens
MVSWGRFICLVVVTMATLSLARPSFSLVEDTTLEPEEPPTKYQISQPEVRLGAEEERKLEFEHVVRVSEY

SEQ ID NO: 823227 - protein, 366 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQGRRC

SEQ ID NO: 823228 - protein, 821 aa, Homo sapiens; identical to SEQ ID NO: 823209

SEQ ID NO: 823229 - protein, 366 aa, Homo sapiens; identical to SEQ ID NO: 823227

SEQ ID NO: 823230 - protein, 366 aa, Homo sapiens; identical to SEQ ID NO: 823227

SEQ ID NO: 823231 - protein, 324 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYADTGQAPGRRLLWASGHGGSSGN

SEQ ID NO: 823232 - protein, 795 aa, Homo sapiens
TRSSPSGVWEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823233 - protein, 653 aa, Homo sapiens
IPTAASRPSPRLPGRCLRLLEGVRSRAELGAARARGADWQRGRRRPGNGSGFSGGVTHREKAGAAAAARAAAGGERGGEPSGRAAGAERARERARPPQSSGAAGLHAAYLARRGDCSPGWRGPAASPGGPEAAACLRALSLRNSRAKFGGGNAKLLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 823234 - protein, 366 aa, Homo sapiens; identical to SEQ ID NO: 823227

SEQ ID NO: 823235 - protein, 366 aa, Homo sapiens; identical to SEQ ID NO: 823227

SEQ ID NO: 823236 - protein, 153 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKSK

SEQ ID NO: 823237 - protein, 254 aa, Homo sapiens; identical to SEQ ID NO: 823225

SEQ ID NO: 823238 - protein, 183 aa, Homo sapiens
IPTAASRPSPRLPGRCLRLLEGVRSRAELGAARARGADWQRGRRRPGNGSGFSGGVTHREKAGAAAAARAAAGGERGGEPSGRAAGAERARERARPPQSSGAAGLHAAYLARRGDCSPGWRGPAASPGGPEAAACLRALSLRNSRAKFGGGNAKPESFLPLVPQIRGQPAGVMPALLRSLGYA

SEQ ID NO: 823239 - protein, 297 aa, Homo sapiens
PCPPPGARHFLPGPVKALPGGGGGDSVRAMVALENPECGPEAAEGTPGGRRLLPLPSCLPALASSQVKRLSASRRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 823240 - protein, 297 aa, Homo sapiens; identical to SEQ ID NO: 823239

SEQ ID NO: 823241 - protein, 297 aa, Homo sapiens; identical to SEQ ID NO: 823239

SEQ ID NO: 823242 - protein, 297 aa, Homo sapiens; identical to SEQ ID NO: 823239

SEQ ID NO: 823243 - protein, 269 aa, Homo sapiens
MAVVGPFSEILAGLDPEDHPCPGPQPLPSCLPALASSQVKRLSASRRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 823244 - protein, 146 aa, Homo sapiens
MNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 823245 - protein, 362 aa, Homo sapiens
PLPASGRPSLPARPGEGPAGRRRRRQRASHGRAGEPRVRPGGGGGHPGRAAAASCYVAQAGLEPLSSSDPPASASHNAGITGMSHHTQPVFTIVSASCDVRMKQNRILRAQDFTHREGPLPSCLPALASSQVKRLSASRRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 823246 - protein, 276 aa, Homo sapiens
PCPPPGARHFLPGPVKALPGGGGGDSVRAMVALENPECGPEAAEGTPGGRRLLRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 823247 - protein, 146 aa, Homo sapiens; identical to SEQ ID NO: 823244

SEQ ID NO: 823248 - protein, 297 aa, Homo sapiens; identical to SEQ ID NO: 823239

SEQ ID NO: 823249 - protein, 297 aa, Homo sapiens; identical to SEQ ID NO: 823239

SEQ ID NO: 823250 - protein, 66 aa, Homo sapiens
TDHLSWEVLNLTIKKDCEGLMPSQRRAVAELTDGRRTGRMCMKVSNRHLDFLPPGLLLSAYLEQHS

SEQ ID NO: 823251 - protein, 147 aa, Homo sapiens
PCPPPGARHFLPGPVKALPGGGGGDSVRAMVALENPECGPEAAEGTPGGRRLLPLPSCLPALASSQVKRLSASRRKQHFINQAVRNSDLVPKAKGRKSLQRLENTQYLLTLLETDGGLPGLEDFQPEASALALPCLSPHPVSPRPPA

SEQ ID NO: 823252 - protein, 85 aa, Homo sapiens
DDKKGGRLVLGSPWCLGVPKCHPGPESICFHLAQYLLTLLETDGGLPGLEDGDLAPPASPGIFAEACNNATYVEVWPPTPSLPPH

SEQ ID NO: 823253 - protein, 116 aa, Homo sapiens
GTICDSTTGSWYRRSVHLMPLAALAALVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 823254 - protein, 116 aa, Homo sapiens; identical to SEQ ID NO: 823253

SEQ ID NO: 823255 - protein, 391 aa, Homo sapiens
MQWDSSGDLHYIGVEDARVGHHDYSIVRQHTHVTCEHDSGLAKLESLNYGKPIDGHTSWDERHRKQRQVQAEKSLNARKEGDHGRRQERDNIAKRAELERCASAQSDRRDGDNKGSNSATKMRNDTKEKVATNDVQKEEGENTGTDKRDDKGRHMEKRRPSLRTNTAKKLERQQPHTRRETNNNNEENNIQVGTKAHGTQRKKIPRWDVSPNTRDHKQIPESTRRRPTLAKEPLGEDAQQRDKRTNENQRNRGELPKNKRIKIQSQKQQNNIEEKTGNNKHQWMYNINNWSPNRRIQGHKTLPKTTPKTIITRHLTSTNDRQADTLSNARSEQHEHTTQRQKNSETEAEDSTDTREEHTRKRTTRIKKTKDKREITAKKKKHTTHRTEKQN

SEQ ID NO: 823256 - protein, 298 aa, Homo sapiens
MALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 823257 - protein, 298 aa, Homo sapiens; identical to SEQ ID NO: 823256

SEQ ID NO: 823258 - protein, 298 aa, Homo sapiens; identical to SEQ ID NO: 823256

SEQ ID NO: 823259 - protein, 298 aa, Homo sapiens; identical to SEQ ID NO: 823256

SEQ ID NO: 823260 - protein, 298 aa, Homo sapiens; identical to SEQ ID NO: 823256

SEQ ID NO: 823261 - protein, 298 aa, Homo sapiens; identical to SEQ ID NO: 823256

SEQ ID NO: 823262 - protein, 298 aa, Homo sapiens; identical to SEQ ID NO: 823256

SEQ ID NO: 823263 - protein, 262 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAVAPQRAPILRPAFVPHVLQRADSALSSAAGRAPPYGPTAPSPGPRGPPSAWAPWTTHDAATNGSGSRAPAGLHGCTEAPSGRASSTPRAGPRPGVGPEREGRGSGGGGGWAGGG

SEQ ID NO: 823264 - protein, 364 aa, Homo sapiens
AGRHPREPTRTKGESRQQNQRRRLSRDCSSGDSDDGSDGWGGASPGTPGCRRTRGPGSWRWHPGQKRRGTLEGNGGGDGPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 823265 - protein, 145 aa, Homo sapiens
MSSIMMMMAARRRQKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 823266 - protein, 1528 aa, Homo sapiens
ELAQNHSRPAPASAPGGGGGGDPNMATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823267 - protein, 993 aa, Homo sapiens
MFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823268 - protein, 68 aa, Homo sapiens
MQVVTCLTRDSYLTHCFLQHLMVVLSSLERTPSPEPVDKDFYSEFGNKTTGKMENYELIHPDLNYKIL

SEQ ID NO: 823269 - protein, 1504 aa, Homo sapiens
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823270 - protein, 663 aa, Homo sapiens [sequence omitted]

SEQ ID NO: 823271 - protein, 1553 aa, Homo sapiens
ELAQNHSRPAPASAPGGGGGGDPNMATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQDHETCWRVAEVLREGTKGDGTHTLQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823272 - protein, 1265 aa, Homo sapiens
MALWLTSVVPALWEAEEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823273 - protein, 1270 aa, Homo sapiens
MIVLATNLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823274 - protein, 1470 aa, Homo sapiens
ELAQNHSRPAPASAPGGGGGGDPNMATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSC

SEQ ID NO: 823275 - protein, 1195 aa, Homo sapiens
NLRLGTRPGCDGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823276 - protein, 1234 aa, Homo sapiens
ELAQNHSRPAPASAPGGGGGGDPNMATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQVLRAKA

SEQ ID NO: 823277 - protein, 993 aa, Homo sapiens; identical to SEQ ID NO: 823267

SEQ ID NO: 823278 - protein, 993 aa, Homo sapiens; identical to SEQ ID NO: 823267

SEQ ID NO: 823279 - protein, 1001 aa, Homo sapiens
MTLNAAMVHINRALKLIIRLFLVEDLVDSLKLAVFIGIDKHRCLSMPPAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823280 - protein, 993 aa, Homo sapiens; identical to SEQ ID NO: 823267

SEQ ID NO: 823281 - protein, 697 aa, Homo sapiens
RPLQHRMAMCWGAKHELQVRVELLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823282 - protein, 1528 aa, Homo sapiens; identical to SEQ ID NO: 823266

SEQ ID NO: 823283 - protein, 343 aa, Homo sapiens [sequence omitted]

SEQ ID NO: 823284 - protein, 326 aa, Homo sapiens
TVRRPGALAVYWVLHEAPPGFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 823285 - protein, 253 aa, Homo sapiens [sequence omitted]

SEQ ID NO: 823286 - protein, 81 aa, Homo sapiens
QLELVTPNCFFDDVQGHDLMGSVTLDHFGEVPGGPARASQGREVQWQVFVPSAESREKLISLLARQWEALCGRELPVELTG

SEQ ID NO: 823287 - protein, 83 aa, Homo sapiens
LDYVSELGRPAANTKIGPRLSSTQSVCGECNKKYRALTPTGAGQQAFVFSKNVLSSLWYLNLTVLAENVNMCVCCVNSFSCWE

SEQ ID NO: 823288 - protein, 1208 aa, Homo sapiens
ELAQNHSRPAPASAPGGGGGGDPNMATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPVEVPAPAPAAASASGPAKTPAPAEASTSALVPEETPVEAPAPPPAEAPAQYPSEHLIQATSEENQIPSHLPACPSLRHVASLRGSAIIELFHSSIAEVAARVWVPAMARPVLRARPSLASGQPQVPGLP

SEQ ID NO: 823289 - protein, 515 aa, Homo sapiens
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGILGDE

SEQ ID NO: 823290 - protein, 515 aa, Homo sapiens; identical to SEQ ID NO: 823289

SEQ ID NO: 823291 - protein, 206 aa, Homo sapiens
NLRLGTRPGCDGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGILGDE

SEQ ID NO: 823292 - protein, 606 aa, Homo sapiens
ELAQNHSRPAPASAPGGGGGGDPNMATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGNRVCILLLVEPHSPAWAPWLGWGWGRGASTCFQQGQTQGGQCLLQAGPRGGTHGRGAWPDASCCLLGEDSQL

SEQ ID NO: 823293 - protein, 327 aa, Homo sapiens [sequence omitted]

SEQ ID NO: 823294 - protein, 263 aa, Homo sapiens
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 823295 - protein, 263 aa, Homo sapiens; identical to SEQ ID NO: 823294

SEQ ID NO: 823296 - protein, 263 aa, Homo sapiens; identical to SEQ ID NO: 823294

SEQ ID NO: 823297 - protein, 253 aa, Homo sapiens
MYIAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 823298 - protein, 214 aa, Homo sapiens
MCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 823299 - protein, 253 aa, Homo sapiens
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNIVVKAGCHRVMC

SEQ ID NO: 823300 - protein, 153 aa, Homo sapiens
MKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 823301 - protein, 148 aa, Homo sapiens
GGAGGSVECRCRLRRKSLARPGGNLGGLTAAAAAVGVGFASLNVGGARLVNCREPPGLRWRTLRPVGGRHPGAGPPSRHVSSGGSLRLPDCRLECSGTTWAHCNLRFPGSSDSPALASRVVGITGARHHARADSWKIFKSACTLKKYF

SEQ ID NO: 823302 - protein, 287 aa, Homo sapiens
MHRPPGAGEARPRVGDGNAWVPGTWGAGSGARGHGRSGKPARQRSLSGMDAAPHADLPPRLHPALLPVTHMTRTSGTGLLPRKGLPKSFRRLQCPTGGRASPATTPARAAAEAGKGPLARARHHPARAPGDTTLGGPSKGRRWCRPRPPIGRGGGGVASGAWFRAPERASRIASRTRELAPWGGVVAGRGRRDGGGFGLRSGRRQGLGLGLGLRLRLRLPWERVPADAEVALTLAPRLPFQVLLHVLFEHAVGYALLALKEVEEISLLQPQRWVRSVGSFGGPADPH

SEQ ID NO: 823303 - protein, 312 aa, Homo sapiens
RSGTGLGGAAAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMAWTYLALTVNIESFPTVGPNGTPTSSYWRQITIADVLWERRDQTRAQ

SEQ ID NO: 823304 - protein, 607 aa, Homo sapiens
GSGNEGTMAGRGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 823305 - protein, 351 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRYQ

SEQ ID NO: 823306 - protein, 606 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 823307 - protein, 352 aa, Homo sapiens
MYEAGFKFGRGWAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRYQ

SEQ ID NO: 823308 - protein, 728 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRYQLRAPAHNQVPLLVPTACWGITVMADQGSLTYTGLCYGGDGQSWCLSDSQGPAKGPSFQVSDIGCLPSASGSYGLACIGVEIQSGLRLTQDFGVRGGEELSCLANGVEISDLKLSTEYSLRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 823309 - protein, 498 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEVSRQHGPGRDPRL

SEQ ID NO: 823310 - protein, 490 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEGDRC

SEQ ID NO: 823311 - protein, 668 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQVSWALLGVEWHELAVGGDELSEPDLVEWRQKNWFNEPDPIKPERSPQSTRSLQALLALFFDQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 823312 - protein, 451 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQVSWALLGVEWHS

SEQ ID NO: 823313 - protein, 606 aa, Homo sapiens; identical to SEQ ID NO: 823306

SEQ ID NO: 823314 - protein, 568 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 823315 - protein, 351 aa, Homo sapiens; identical to SEQ ID NO: 823305

SEQ ID NO: 823316 - protein, 617 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGGPFGGPKGPQTSTSIPKRKKSTPKEETVNDPEEAGHRSGSKKKRKFSKEEPVSSGPEEAVGKSSSKKKKKFHKASQED

SEQ ID NO: 823317 - protein, 490 aa, Homo sapiens; identical to SEQ ID NO: 823310

SEQ ID NO: 823318 - protein, 173 aa, Homo sapiens
MIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRYQ

SEQ ID NO: 823319 - protein, 397 aa, Homo sapiens
MYEAGFKFGRGWAMVLLHVLFEHAVGYALLALKEVEEISLLQPQVEESVLNLGKFHSIVRLVAFCPFASSQVALENANAVSEDLNAVVPMAGPGFAVMTCDIKSVNPLSAITDVSMSLSNAMMGRDLGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRYQ

SEQ ID NO: 823320 - protein, 351 aa, Homo sapiens; identical to SEQ ID NO: 823305

SEQ ID NO: 823321 - protein, 306 aa, Homo sapiens
MYEAGFKFGRGWAMVLLHVLFEHAVGYALLALKEVEEISLLQPQLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRYQ

SEQ ID NO: 823322 - protein, 351 aa, Homo sapiens; identical to SEQ ID NO: 823305

SEQ ID NO: 823323 - protein, 498 aa, Homo sapiens; identical to SEQ ID NO: 823309

SEQ ID NO: 823324 - protein, 498 aa, Homo sapiens; identical to SEQ ID NO: 823309

SEQ ID NO: 823325 - protein, 251 aa, Homo sapiens
MYEAGFKFGRGWPWELCSFPCGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGVSAEPGNLHKVGARLIAHAGSLTNLAKYPASTVQILGAEKALFRYQ

SEQ ID NO: 823326 - protein, 351 aa, Homo sapiens; identical to SEQ ID NO: 823305

SEQ ID NO: 823327 - protein, 380 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRAEDRVHSKIGLLFIHFMASVPKQGVPIRESG

SEQ ID NO: 823328 - protein, 333 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMVEFCLVGNSELSAGGYRNRNYDYAPERQEPTRHGEGAVIDGRTRQYTQVGELRKEHMTPARDTSMRRHY

SEQ ID NO: 823329 - protein, 273 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMAWTYLALTG

SEQ ID NO: 823330 - protein, 335 aa, Homo sapiens
AGRESDEAGAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMVPSPWAGFLPAVHRSFPRWGYLIRRAHPSGPLYCPLAIGGGALPCAPRFPGSLAAQGQFSLWRTPAFSFAT

SEQ ID NO: 823331 - protein, 75 aa, Homo sapiens
GYHFPELVKIINDNATYCRLAQFIGNRRELNEDKLEKLEELTMDGAKAKAILDASRSSMGVSAEPGNLHKVWGSK

SEQ ID NO: 823332 - protein, 103 aa, Homo sapiens
PKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSS

SEQ ID NO: 823333 - protein, 1018 aa, Homo sapiens
RGREGSSQREPPALPADPRRAHGALRAGTACGPRGQFPAVVRSRARTPAGPRAAGRMTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 823334 - protein, 1045 aa, Homo sapiens
RGREGSSQREPPALPADPRRAHGALRAGTACGPRGQFPAVVRSRARTPAGPRAAGRMTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 823335 - protein, 444 aa, Homo sapiens
VAGSQVPPVRAQRRSKAFRLLAERGAAAAMLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 823336 - protein, 444 aa, Homo sapiens; identical to SEQ ID NO: 823335

SEQ ID NO: 823337 - protein, 444 aa, Homo sapiens; identical to SEQ ID NO: 823335

SEQ ID NO: 823338 - protein, 278 aa, Homo sapiens
VAGSQVPPVRAQRRSKAFRLLAERGAAAAMLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKLLTLVHFVAPGRDA

SEQ ID NO: 823339 - protein, 463 aa, Homo sapiens
VAGSQVPPVRAQRRSKAFRLLAERGAAAAMLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEELFWQGPGVQSRSFVPFGGPQIALLLPFSSGDLREG

SEQ ID NO: 823340 - protein, 288 aa, Homo sapiens [sequence omitted]

SEQ ID NO: 823341 - protein, 317 aa, Homo sapiens
VAGSQVPPVRAQRRSKAFRLLAERGAAAAMLWSGCRRFGARLGCLPGGLRVLVQTGHRSLTSCIDRSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 823342 - protein, 212 aa, Homo sapiens
MCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 823343 - protein, 463 aa, Homo sapiens; identical to SEQ ID NO: 823339

SEQ ID NO: 823344 - protein, 100 aa, Homo sapiens
FTLSGCIATRGNHSFLSSQPGWLWAASAWQICNQALQMHGGYGYLKDYAVQQYVRDSRVHQILEELFWQGPGVQSRSFVPFGGPQIALLLPFSSGDLREG

SEQ ID NO: 823345 - protein, 54 aa, Homo sapiens
EDFLEDRIVLGSLDLTDFLTFSLLPFDPSSGSGSDAASLLTSAKKQGDHYILNG

SEQ ID NO: 823346 - protein, 106 aa, Homo sapiens
MHGGYGYLKDYAVQQYVRDSRVHQILEGKNCQRLFSSLQNGDGIAAFPTLCPHASWASGCSQALSVSRLPPPSRSTELFWQGPGVQSRSFVPFGGPQIALLLPFSS

SEQ ID NO: 823347 - protein, 688 aa, Homo sapiens
MATASGASDLSGSGAPPPGVGAQAAAAAEEEEREVVRVRVKKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQLSRPEELRLRIYHGGVEPSLRKVVWRYLLNVYPDGLTGRERMDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 823348 - protein, 655 aa, Homo sapiens
EFREEALTKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQLSRPEELRLRIYHGGVEPSLRKVVWRYLLNVYPDGLTGRERMDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 823349 - protein, 688 aa, Homo sapiens; identical to SEQ ID NO: 823347

SEQ ID NO: 823350 - protein, 728 aa, Homo sapiens
RGSRSTRRGGGQRSAVTLRRAAAGWQQPPGPRTCLAPERPRPVWELRRRRPLRRRSERWCGSESSMVMGPLVAYPMSSLPRKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQLSRPEELRLRIYHGGVEPSLRKVVWRYLLNVYPDGLTGRERMDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 823351 - protein, 434 aa, Homo sapiens
MDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 823352 - protein, 434 aa, Homo sapiens; identical to SEQ ID NO: 823351

SEQ ID NO: 823353 - protein, 517 aa, Homo sapiens
MVGRTLSKVQQVLSWSYGEDVKPFKPPLSDAEFHTYLNHEGQLSRPEELRLRIYHGGVEPSLRKVVWRYLLNVYPDGLTGRERMDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 823354 - protein, 236 aa, Homo sapiens
MIPLHPTGWGATVSRHPETGGGGMATASGASDLSGSGAPPPGVGAQAAAAAEEEEREVVRVRVKKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPRRVERYELDRTSGGF

SEQ ID NO: 823355 - protein, 102 aa, Homo sapiens
MRIPLHPTGWGATVSRHPETGGGGMATASGASDLSGSGAPPPGVGAQAAAAAEEEEREVVRVRVKKCESFLPPEFRSFAVDPQITSLDVLQHILIRAFDLSG

SEQ ID NO: 823356 - protein, 38 aa, Homo sapiens
MVMGPLVAYPMSSLPRKCESFLPPEFRSFAVDPQITSL

SEQ ID NO: 823357 - protein, 74 aa, Homo sapiens
HEALHEFLNPILKHKRNKSIIGRTAPATAPQPGSKRRRLGPVPHADLLVCLTGVHSRIIGVQLGIQLLCRKLLL

SEQ ID NO: 823358 - protein, 84 aa, Homo sapiens
TVGLSTRLVGTEDGGCCRTVAPSVGCPTCECHSLGHFCHCSPQACCMWKNELDKFIVFWFQSSKIIQHQFLMPCTCCHPACTLF

SEQ ID NO: 823359 - protein, 86 aa, Homo sapiens
SGVSARPVAPECTEDGGCCRTVAPSVGCPTCECHSLGHFCHCSPQACCMWKNELDKFIVFWFQSSKIIQHQFLMPCTCCHPACTLF

SEQ ID NO: 823360 - protein, 86 aa, Homo sapiens; identical to SEQ ID NO: 823359

SEQ ID NO: 823361 - protein, 86 aa, Homo sapiens; identical to SEQ ID NO: 823359

SEQ ID NO: 823362 - protein, 84 aa, Homo sapiens
MLKNTMVGGRSGGQGRNPGHRDSPPGILPYDISQRGPRDFEGTGIPVCLSGKHRRFFQVGGPVNQVGRTQAHSGSFFLPHNLSF

SEQ ID NO: 823363 - protein, 84 aa, Homo sapiens; identical to SEQ ID NO: 823358

SEQ ID NO: 823364 - protein, 74 aa, Homo sapiens; identical to SEQ ID NO: 823357

SEQ ID NO: 823365 - protein, 74 aa, Homo sapiens; identical to SEQ ID NO: 823357

SEQ ID NO: 823366 - protein, 74 aa, Homo sapiens; identical to SEQ ID NO: 823357

SEQ ID NO: 823367 - protein, 74 aa, Homo sapiens; identical to SEQ ID NO: 823357

SEQ ID NO: 823368 - protein, 74 aa, Homo sapiens; identical to SEQ ID NO: 823357

SEQ ID NO: 823369 - protein, 74 aa, Homo sapiens; identical to SEQ ID NO: 823357

SEQ ID NO: 823370 - protein, 74 aa, Homo sapiens; identical to SEQ ID NO: 823357

SEQ ID NO: 823371 - protein, 74 aa, Homo sapiens; identical to SEQ ID NO: 823357

SEQ ID NO: 823372 - protein, 74 aa, Homo sapiens; identical to SEQ ID NO: 823357

SEQ ID NO: 823373 - protein, 84 aa, Homo sapiens; identical to SEQ ID NO: 823358

SEQ ID NO: 823374 - protein, 84 aa, Homo sapiens; identical to SEQ ID NO: 823358

SEQ ID NO: 823375 - protein, 84 aa, Homo sapiens; identical to SEQ ID NO: 823358

SEQ ID NO: 823376 - protein, 74 aa, Homo sapiens; identical to SEQ ID NO: 823357

SEQ ID NO: 823377 - protein, 74 aa, Homo sapiens; identical to SEQ ID NO: 823357

SEQ ID NO: 823378 - protein, 74 aa, Homo sapiens; identical to SEQ ID NO: 823357

SEQ ID NO: 823379 - protein, 84 aa, Homo sapiens; identical to SEQ ID NO: 823358

SEQ ID NO: 823380 - protein, 84 aa, Homo sapiens; identical to SEQ ID NO: 823358

SEQ ID NO: 823381 - protein, 84 aa, Homo sapiens; identical to SEQ ID NO: 823358

SEQ ID NO: 823382 - protein, 74 aa, Homo sapiens; identical to SEQ ID NO: 823357

SEQ ID NO: 823383 - protein, 74 aa, Homo sapiens; identical to SEQ ID NO: 823357

SEQ ID NO: 823384 - protein, 74 aa, Homo sapiens; identical to SEQ ID NO: 823357

SEQ ID NO: 823385 - protein, 74 aa, Homo sapiens; identical to SEQ ID NO: 823357

SEQ ID NO: 823386 - protein, 74 aa, Homo sapiens; identical to SEQ ID NO: 823357

SEQ ID NO: 823387 - protein, 74 aa, Homo sapiens; identical to SEQ ID NO: 823357

SEQ ID NO: 823388 - protein, 74 aa, Homo sapiens; identical to SEQ ID NO: 823357

SEQ ID NO: 823389 - protein, 74 aa, Homo sapiens; identical to SEQ ID NO: 823357

SEQ ID NO: 823390 - protein, 84 aa, Homo sapiens; identical to SEQ ID NO: 823358

SEQ ID NO: 823391 - protein, 74 aa, Homo sapiens; identical to SEQ ID NO: 823357

SEQ ID NO: 823392 - protein, 74 aa, Homo sapiens; identical to SEQ ID NO: 823357

SEQ ID NO: 823393 - protein, 74 aa, Homo sapiens; identical to SEQ ID NO: 823357

SEQ ID NO: 823394 - protein, 74 aa, Homo sapiens; identical to SEQ ID NO: 823357

SEQ ID NO: 823395 - protein, 74 aa, Homo sapiens; identical to SEQ ID NO: 823357

SEQ ID NO: 823396 - protein, 74 aa, Homo sapiens; identical to SEQ ID NO: 823357

SEQ ID NO: 823397 - protein, 74 aa, Homo sapiens; identical to SEQ ID NO: 823357

SEQ ID NO: 823398 - protein, 192 aa, Homo sapiens
MAAAVGRLLRASVARHVSAIPWGISATAALRPAACGRTSLTNLLCSGSSQAKLFSTIIHAQFLMPCTCCHPSCTLYSGFTSLFRGSFRSFRPFAASGVLYPRDAPAPLLIWWWCFRVGFVVCLSFSSMMGCPVVLSNKDGIFLLFLFFSPSSSHTSLSSTPPPALLPLFSPRSFVLLLIFIHILPLLHSPSL

SEQ ID NO: 823399 - protein, 214 aa, Homo sapiens
AASGMQRPEAWPRPHPGEGAAAAQAGGPAPPARAGEPSGLRLQEPSLYTIKAVFILDNDGRRLLAKYYDDTFPSMKEQMVFEKNVFNKTSRTESEIAFFGGMTIVYKNSIDLFLYVVGSSYENELMLMSVLTCLFESLNHMLRKNVEKRWLLENMDGAFLVLDEIVDGGVILESDPQQVIQKVNFRADDGGLTEQSVAQVLQSAKEQIKWSLLK

SEQ ID NO: 823400 - protein, 71 aa, Homo sapiens
AASGMQRPEAWPRPHPGEGAAAAQAGGPAPPARAGEPSGLRLQEPSLYTIKAVFILDNDGRRLLAKCDSGE

SEQ ID NO: 823401 - protein, 136 aa, Homo sapiens
MVFEKNVFNKTSRTESEIAFFGGMTIVYKNSIDLFLYVVGSSYENELMLMSVLTCLFESLNHMLRKNVEKRWLLENMDGAFLVLDEIVDGGVILESDPQQVIQKVNFRADDGGLTEQSVAQVLQSAKEQIKWSLLK

SEQ ID NO: 823402 - protein, 151 aa, Homo sapiens
AFAAGDVSGLGRWVKYPGWRFQRFLWRGNEGLGQGIGRCIAARVRNTLALRVPTVTCKSLVRPENAEAGHEACGSCGCDARAAILGAGGGNRYPNFPSVRTWRSHPSCEGRLRLMAQARVPSLEQYRDGYHEGGGTLAERWRNVGGVRGVG

SEQ ID NO: 823403 - protein, 138 aa, Homo sapiens
MVFEKNVFNKTSRTESEIAFFGGMTIVYKNSIDLFLYVVGSSYENELMLMSVLTCLFESLNHMLRKNVEKRWLLENMDGAFLVLDEIVDGGVILESDPQQVIQKVNFRADDGGLTEQSVAQVSLLRLILLVWNFPPWR

SEQ ID NO: 823404 - protein, 94 aa, Homo sapiens
AASGMQRPEAWPRPHPGEGAAAAQAGGPAPPARAGEPSGLRLQEPSLYTIKAVFILDNDGRRLLAKYYDDTFPSMKEQMVFEKNVFNKTSRTEM

SEQ ID NO: 823405 - protein, 104 aa, Homo sapiens
AASGMQRPEAWPRPHPGEGAAAAQAGGPAPPARAGEPSGLRLQEPSLYTIKAVFILDNDGRRLLAKYYDDTFPSMKEQMVFEKNVFNKTSRTETDAHVCSHLPV

SEQ ID NO: 823406 - protein, 169 aa, Homo sapiens
AASGMQRPEAWPRPHPGEGAAAAQAGGPAPPARAGEPSGLRLQEPSLYTIKAVFILDNDGRRLLAKYYDDTFPSMKEQMVFEKNVFNKTSRTESEIAFFGGMTIVYKNSIDLFLYVVGSSYENELMLMSVLTCLFESLNHMLRKNVEKRWLLENMDGAFLVLDEIVDGG

SEQ ID NO: 823407 - protein, 103 aa, Homo sapiens
MALSTIVSQRKQIKRKAPRGFLKRVFKRKKPQLRLEKSGDLLVRFHPFSGWEWGTGEVHLNCLLFVHRLAEESRTNACASKCRVINKEHVLAAAKVILKKSRG

SEQ ID NO: 823408 - protein, 264 aa, Homo sapiens
RLGHRSSGSEARGDVGSATLEPTGTPAEMEASDGQGGEGDKPLEQVTNVSCLETSSSASPARDSLMRHAKGLDQDTFKTCKEYLRPLKKFLRKLHLPRDLPQKKKLKYMKQSLVVLGDHINTFLQHYCQAWEIKHWRKMLWRFISLFSELEAKQLRRLYKYTKSSQPAKFLVTFCASDAPERSLLADREDSLPKLCHAWGLHSNISGMKERLSNMQTPGQGSPLPGQPRSQDHVKKDSLRELSQKPKLKRKRIKEAPETPETEP

SEQ ID NO: 823409 - protein, 235 aa, Homo sapiens
AHRVSALGLGSLEGSRVTNVSCLETSSSASPARDSLMRHAKGLDQDTFKTCKEYLRPLKKFLRKLHLPRDLPQKKKLKYMKQSLVVLGDHINTFLQHYCQAWEIKHWRKMLWRFISLFSELEAKQLRRLYKYTKSSQPAKFLVTFCASDAPERSLLADREDSLPKLCHAWGLHSNISGMKERLSNMQTPGQGSPLPGQPRSQDHVKKDSLRELSQKPKLKRKRIKEAPETPETEP

SEQ ID NO: 823410 - protein, 397 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823411 - protein, 397 aa, Homo sapiens; identical to SEQ ID NO: 823410

SEQ ID NO: 823412 - protein, 370 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823413 - protein, 679 aa, Homo sapiens
RAQTPQLRREAARAGSFLFPKCRQSPRSHGQPFRQLRSHWQAPRQDGRPRREEDDVPPEEKRLRLGLEGGSAQPEDCEDGKDAPRPGREETGTQTGGDGRGDLLCLPYSLVEGQDYKSENSTLLPGAKNSLQDSVSASQATGKAEETGQRTHASGTYSFLDRTQHSDIKADCNTCVEIEDRKVEPANGDSERKEQACEQMREPQSVSEWKSMCLMKISYVESHLQSFHDSSLWLVHGCEVLSFQALLWVTGEWGNQGICVHRHIDSKSDHSHKFLSQVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823414 - protein, 343 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVMLHTATPSLPLPLPLPTVTVTDEFMLPTPTTTHLLQPPPTALVP

SEQ ID NO: 823415 - protein, 417 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823416 - protein, 436 aa, Homo sapiens
LSKRTQEEEDAVTGISYQGEAPLLALRIHNDEGIFLPGLYLLMFLDVLGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823417 - protein, 374 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDRNQFVFVAADEISCNTSAVTDEFMLPTPTTTHLLQPPPTALVP

SEQ ID NO: 823418 - protein, 102 aa, Homo sapiens
RVVYQEPVYGNKLLQGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823419 - protein, 463 aa, Homo sapiens
LARGCRLLLPRTSPVLCFPGEETGGTLQPTMKSWQLIAVVGDALQDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 823420 - protein, 202 aa, Homo sapiens [sequence omitted]

SEQ ID NO: 823421 - protein, 283 aa, Homo sapiens
RSGDAAGVPRWRRRRLPEGRGGVPAAKAGPTRLAADRPDLRPEDGRQPPLRGPGLGRAAAAAPGDALAGPGLSLLNLGRRRARAPGSRAMALRELKVCLLGDTGVGKSSIVWRFVEDSFDPNINPTIGASFMTKTVQYQNELHKFLIWDTAGQERFRALAPMYYRGSAAAIIVYDITKEETFSTLKNWVKELRQHGPPNIVVAIAGNKCDLIDVREVMERDAKDYADSIHAIFVETSAKNAININELFIEISRRIPSTDANLPSGGKGFKLRRQPSEPKRSCC

SEQ ID NO: 823422 - protein, 283 aa, Homo sapiens; identical to SEQ ID NO: 823421

SEQ ID NO: 823423 - protein, 73 aa, Homo sapiens
GQVTRPASQDGGGGGSRKAAAASRLLRRAPRGWQRTGRTYGACTSQEPALQRLVAISGVRNVVANEHRRDMLL

SEQ ID NO: 823424 - protein, 122 aa, Homo sapiens [sequence omitted]

SEQ ID NO: 823425 - protein, 283 aa, Homo sapiens; identical to SEQ ID NO: 823421

SEQ ID NO: 823426 - protein, 220 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLAQ

SEQ ID NO: 823427 - protein, 141 aa, Homo sapiens
TRTPTRPGVHPRSAPASPRLKLSSSLRTMSSCGTLTWATSSPAHPTWAPGCGQVCISSCPTWASMRSSRRCLSGCDFRSEAQAVWTRLRWAGSSTSPNADRLGFSEVELVQMVVDGVKLLIEMEQRLEQGQAIDDLMPAQK

SEQ ID NO: 823428 - protein, 238 aa, Homo sapiens
GSCSPASLRELPTDGAPPPPPGRPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVPPPHASTATTH

SEQ ID NO: 823429 - protein, 71 aa, Homo sapiens
IRLLEDDRREAQAVWTRLRWAGSSTSPNADRLGFSEVELVQMVVDGVKLLIEMEQRLEQGQAIDDLMPAQK

SEQ ID NO: 823430 - protein, 150 aa, Homo sapiens
LTAVGYSVFWLSLASGGARVDEYYCRPHNERVVAVARVLQSASLPDTPCARAKSPELACTGGHTGDTLDQRTIHARQLAPRTRMGCDKDARIFQWPSAGAAQGASAGAVTPIASRVIGTTHAPLMFAVWRALSLAVETSVTLGRVYFFDG

SEQ ID NO: 823431 - protein, 220 aa, Homo sapiens; identical to SEQ ID NO: 823426

SEQ ID NO: 823432 - protein, 220 aa, Homo sapiens; identical to SEQ ID NO: 823426

SEQ ID NO: 823433 - protein, 220 aa, Homo sapiens; identical to SEQ ID NO: 823426

SEQ ID NO: 823434 - protein, 220 aa, Homo sapiens; identical to SEQ ID NO: 823426

SEQ ID NO: 823435 - protein, 220 aa, Homo sapiens; identical to SEQ ID NO: 823426

SEQ ID NO: 823436 - protein, 261 aa, Homo sapiens
KNQNRGYVYPEVLVRAFFKCCEGELRRNGAPPPPPAPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLAQ

SEQ ID NO: 823437 - protein, 220 aa, Homo sapiens; identical to SEQ ID NO: 823426

SEQ ID NO: 823438 - protein, 563 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLVRVPLRPLAASSLPATSAFPLAPLAGVGPLAARRRRRRREGPAALRVWVPCRASSCAGDLGRAGALRDWAPARGGSGLSNTSPPRDVRWGRGSLAPLPDGPGSWSSLFSFLTPPPLGFYQGLVTPKLLQGQGSYPHCGGRVGLSWRSLAPPHLRPQRMMAAGVLLLGGVPVPPPAPCWRVESWQQPPLLGMAGSSTSGTWEVPLVWGRPGAFFWVCPETSPPSRHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSKR

SEQ ID NO: 823439 - protein, 220 aa, Homo sapiens; identical to SEQ ID NO: 823426

SEQ ID NO: 823440 - protein, 220 aa, Homo sapiens; identical to SEQ ID NO: 823426

SEQ ID NO: 823441 - protein, 151 aa, Homo sapiens
MTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLAQ

SEQ ID NO: 823442 - protein, 272 aa, Homo sapiens
GSCSPASLRELPTDGAPPPPPGRPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQVRGCGRAGRAGPGSSGAHSRLASQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLAQ

SEQ ID NO: 823443 - protein, 298 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLIETLFKSKDYEFMWNPHLGYILTCPSNLGTGLRAGVHIKLPNLGKHEKFSEVLKRLRLQKRGTGGVDTAAVGGVFDVSKR

SEQ ID NO: 823444 - protein, 400 aa, Homo sapiens
GSCSPASLRELPTDGAPPPPPGRPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQVRGCGRAGRAGPGSSGAHSRLASQGGDDLDPNYVLSSRVRTGRSIRGFCLPPHCSRGERRAIEKLAVEGRGRAGRGAAAAASPSRRGPRPLLFTSPGSGSRRRALICARPGSVSRRDRGTEAQPRAHSGLGPREGGSWRGVTAWDRRPGREDWTPADPGGWGPLTSPEVGHGGRAGPRCGLEGRAREPSVLSAPLAALSSLDGDLAGRYYALKSMTEAEQQQLIDDHFLFDKARVAPAAGLGHGPRLARRPRYLAQ

SEQ ID NO: 823445 - protein, 436 aa, Homo sapiens
GSCSPASLRELPTDGAPPPPPGRPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQVRGCGRAGRAGPGSSGAHSRLASQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLVRVPLRPLAASSLPATSAFPLAPLAGVGPLAARRRRRRREGPAALRVWVPCRASSCAGDLGRAGALRDWAPARGGSGLSNTSPPRDVRWGRGSLAPLPDGPGSWSSLFSFLTPPPLGFYQGLVTPKLLQGQGSYPHCGGRVGLSWRSLAPPHLRPQRMMAAGVLLL

SEQ ID NO: 823446 - protein, 113 aa, Homo sapiens
MSSCGTLTWATSSPAHPTWAPGCGQVCISSCPTWASMRSSRRCLSGCDFRSEAQAVWTRLRWAGSSTSPNADRLGFSEVELVQMVVDGVKLLIEMEQRLEQGQAIDDLMPAQK

SEQ ID NO: 823447 - protein, 141 aa, Homo sapiens
PTNHYHGKYPSAAEGEEQLLKLSSSLRTMSSCGTLTWATSSPAHPTWAPGCGQVCISSCPTWASMRSSRRCLSGCDFRSEAQAVWTRLRWAGSSTSPNADRLGFSEVELVQMVVDGVKLLIEMEQRLEQGQAIDDLMPAQK

SEQ ID NO: 823448 - protein, 57 aa, Homo sapiens
MIETLFKSKDYEFMWNPHLGYILTCPSNLGTGLRAGVHIKLPNLGKHEKFSEVLKRL

SEQ ID NO: 823449 - protein, 220 aa, Homo sapiens; identical to SEQ ID NO: 823426

SEQ ID NO: 823450 - protein, 220 aa, Homo sapiens; identical to SEQ ID NO: 823426

SEQ ID NO: 823451 - protein, 220 aa, Homo sapiens; identical to SEQ ID NO: 823426

SEQ ID NO: 823452 - protein, 220 aa, Homo sapiens; identical to SEQ ID NO: 823426

SEQ ID NO: 823453 - protein, 220 aa, Homo sapiens; identical to SEQ ID NO: 823426

SEQ ID NO: 823454 - protein, 238 aa, Homo sapiens
LRCLGTRQRSAKCQPAATALELGAGDARAGPYIASAHSLRRRGLRSRGAGVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLAQ

SEQ ID NO: 823455 - protein, 181 aa, Homo sapiens
MPFSNSHNALKLRFPAEDEFPDLSAHNNHMANVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLAQ

SEQ ID NO: 823456 - protein, 376 aa, Homo sapiens
GSCSPASLRELPTDGAPPPPPGRPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEGRGRAGRGAAAAASPSRRGPRPLLFTSPGSGSRRRALICARPGSVSRRDRGTEAQPRAHSGLGPREGGSWRGVTAWDRRPGREDWTPADPGGWGPLTSPEVGHGGRAGPRCGLEGRAREPSVLSAPLAALSSLDGDLAGRYYALKSMTEAEQQQLIDDHFLFDKARVAPAAGLGHGPRLARRPRYLAQ

SEQ ID NO: 823457 - protein, 452 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKARVAPAAGLGHGPRLARRPRYLVRVPLRPLAASSLPATSAFPLAPLAGVGPLAARRRRRRREGPAALRVWVPCRASSCAGDLGRAGALRDWAPARGGSGLSNTSPPRDVRWGRGSLAPLPDGPGSWSSLFSFLTPQQGCGCPSISPPGGFPALGSLRACRGFRQAFSLTTLFSVCMIETLFKSKDYEFMWNPHLGYILTCPSNLGTGLRAGVHIKLPNLGKHEKFSEVLKRLRLQKRGTGGVDTAAVGGVFDVSKR

SEQ ID NO: 823458 - protein, 220 aa, Homo sapiens; identical to SEQ ID NO: 823426

SEQ ID NO: 823459 - protein, 220 aa, Homo sapiens; identical to SEQ ID NO: 823426

SEQ ID NO: 823460 - protein, 133 aa, Homo sapiens
MARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSKR

SEQ ID NO: 823461 - protein, 133 aa, Homo sapiens; identical to SEQ ID NO: 823460

SEQ ID NO: 823462 - protein, 162 aa, Homo sapiens
MARGQQQGDTGLSKRKWSSMSWPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSKR

SEQ ID NO: 823463 - protein, 195 aa, Homo sapiens
GSCSPASLRELPTDGAPPPPPGRPPAAAMPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDLLRGGAGADGGGRSEAAHRDGTAAGAGPGHRRPHACPEMKPGPHPTPALLLPNLLPGQCPPCTPDVRRLASP

SEQ ID NO: 823464 - protein, 92 aa, Homo sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 823465 - protein, 112 aa, Homo sapiens
MTSSLPWKFHSLSCAPTFVLGLRVPIKRDSQLSISTGHSWVLKLLSSAASPLRKPLFHQYHEALRDCPVSPHASSCLLLSSALSTNGLRPSHRLLLFLHREEASSQLCGRLL

SEQ ID NO: 823466 - protein, 112 aa, Homo sapiens; identical to SEQ ID NO: 823465

SEQ ID NO: 823467 - protein, 112 aa, Homo sapiens; identical to SEQ ID NO: 823465

SEQ ID NO: 823468 - protein, 112 aa, Homo sapiens; identical to SEQ ID NO: 823465

SEQ ID NO: 823469 - protein, 112 aa, Homo sapiens; identical to SEQ ID NO: 823465

SEQ ID NO: 823470 - protein, 112 aa, Homo sapiens; identical to SEQ ID NO: 823465

SEQ ID NO: 823471 - protein, 112 aa, Homo sapiens; identical to SEQ ID NO: 823465

SEQ ID NO: 823472 - protein, 109 aa, Homo sapiens
MTSSLPWKFHSLSCAPTFVLGLRVPIKRDSQLSISTGHSWVLKLLSSAASPLRKPLFHQYHEALRDCPVSPHASSCLLLSSALSTKFQTKRSKQVCADPSEILGPGVRV

SEQ ID NO: 823473 - protein, 109 aa, Homo sapiens; identical to SEQ ID NO: 823472

SEQ ID NO: 823474 - protein, 362 aa, Homo sapiens
GFLARGLGRVRSACRDSLDKGSLMAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 823475 - protein, 175 aa, Homo sapiens
GFLARGLGRVRSACRDSLDKGSLMAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGLENDFSQESS

SEQ ID NO: 823476 - protein, 88 aa, Homo sapiens
GPAEGKGPLSVPPAHPQAPGDELKLTPEYLQLMKYKAIASNSKIYFGKDIPNMFMDSAGSVSKQFEGLADKLSFGLEDEPLETATKEN

SEQ ID NO: 823477 - protein, 135 aa, Homo sapiens
MLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELM

SEQ ID NO: 823478 - protein, 339 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 823479 - protein, 229 aa, Homo sapiens
GFLARGLGRVRSACRDSLDKGSLMAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGKKVSPEHAVLKQGSWNPASLHCLKPGCLQGVMVTYGQEMLKNLVLRSWSQRSSWRMLIAMQQDP

SEQ ID NO: 823480 - protein, 206 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGKKVSPEHAVLKQGSWNPASLHCLKPGCLQGVMVTYGQEMLKNLVLRSWSQRSSWRMLIAMQQDP

SEQ ID NO: 823481 - protein, 124 aa, Homo sapiens [sequence omitted]

SEQ ID NO: 823482 - protein, 114 aa, Homo sapiens
MAQLGAVVAVASSFFCASLFSAVHKIEEGHIGVYYRGGALLTSTSGPGFHLMLPFITSYKSVQVCVIGFGTLPGFKHPLGAFEHKAVPNKIEEVEASTSLKMPNPVSSSLNHYY

SEQ ID NO: 823483 - protein, 206 aa, Homo sapiens; identical to SEQ ID NO: 823480

SEQ ID NO: 823484 - protein, 431 aa, Homo sapiens
MAEITNIRPSFDVSPVVAGLIGASVLVVCVSVTVFVWSCCHQQAEKKHKNPPYKFIHMLKGISIYPETLSNKKKIIKVRRDKDGPGREGGRRNLLVDAAEAGLLSRDKDPRGPSSGSCIDQLPIKMDYGEELRSPITSLTPGESKTTSPSSPEEDVMLGSLTFSVDYNFPKKALVVTIQEAHGLPVMDDQTQGSDPYIKMTILPDKRHRVKTRVLRKTLDPVFDETFTFYGIPYSQLQDLVLHFLVLSFDRFSRDDVIGEVMVPLAGVDPSTGKVQLTRDIIKRNIQKCISRGELQVSLSYQPVAQRMTVVVLKARHLPKMDITGLSGNPYVKVNVYYGRKRIAKKKTHVKKCTLNPIFNESFIYDIPTDLLPDISIEFLVIDFDRTTKNEVVGRLILGAHSVTASGAEHWREVCESPRKPVAKWHSLSEY

SEQ ID NO: 823485 - protein, 431 aa, Homo sapiens; identical to SEQ ID NO: 823484

SEQ ID NO: 823486 - protein, 431 aa, Homo sapiens; identical to SEQ ID NO: 823484

SEQ ID NO: 823487 - protein, 431 aa, Homo sapiens; identical to SEQ ID NO: 823484

SEQ ID NO: 823488 - protein, 431 aa, Homo sapiens; identical to SEQ ID NO: 823484

SEQ ID NO: 823489 - protein, 431 aa, Homo sapiens; identical to SEQ ID NO: 823484

SEQ ID NO: 823490 - protein, 431 aa, Homo sapiens; identical to SEQ ID NO: 823484

SEQ ID NO: 823491 - protein, 172 aa, Homo sapiens
SGCRVRTQRQLPGEKGDVTRHIIKRNIQKCISRGELQVSLSYQPVAQRMTVVVLKARHLPKMDITGLSGNPYVKVNVYYGRKRIAKKKTHVKKCTLNPIFNESFIYDIPTDLLPDISIEFLVIDFDRTTKNEVVGRLILGAHSVTASGAEHWREVCESPRKPVAKWHSLSEY

SEQ ID NO: 823492 - protein, 431 aa, Homo sapiens; identical to SEQ ID NO: 823484

SEQ ID NO: 823493 - protein, 431 aa, Homo sapiens; identical to SEQ ID NO: 823484

SEQ ID NO: 823494 - protein, 94 aa, Homo sapiens
RDSSQRNREAETNPETSNSQTEARTLASSMKVSAALLCLLLIAATFIPQGLAQPDAINAPVTCCYNFTNRKISVQRLASYRRITSSKCPKEAVM

SEQ ID NO: 823495 - protein, 128 aa, Homo sapiens
RDSSQRNREAETNPETSNSQTEARTLASSMKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 823496 - protein, 102 aa, Homo sapiens
SILPLAVIILLRKVSISIAYLNLGNGFGLSCLGSKVEWLVIRHEKISVQRLASYRRITSSKCPKEAVIFKTIVAKEICADPKQKWVQDSMDHLDKQTQTPKT

SEQ ID NO: 823497 - protein, 128 aa, Homo sapiens; identical to SEQ ID NO: 823495

SEQ ID NO: 823498 - protein, 128 aa, Homo sapiens; identical to SEQ ID NO: 823495

SEQ ID NO: 823499 - protein, 128 aa, Homo sapiens; identical to SEQ ID NO: 823495

SEQ ID NO: 823500 - protein, 128 aa, Homo sapiens; identical to SEQ ID NO: 823495

SEQ ID NO: 823501 - protein, 128 aa, Homo sapiens; identical to SEQ ID NO: 823495

SEQ ID NO: 823502 - protein, 457 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823503 - protein, 427 aa, Homo sapiens
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823504 - protein, 273 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVHAVHDVQAGHLSKDIRAVCKESHCGSMDGLWPDETSSSLTACRFYSNHNVKERS

SEQ ID NO: 823505 - protein, 457 aa, Homo sapiens; identical to SEQ ID NO: 823502

SEQ ID NO: 823506 - protein, 467 aa, Homo sapiens
AHTHDNTTAKKKTRGLTRPRSGTRWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823507 - protein, 355 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEER

SEQ ID NO: 823508 - protein, 571 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDCEYGESGSFGLPQGPGAWGPRTPARPTWHGGCWDAGSRRSLLSSPRSCQTGSQAWSTPESGQSLHPAFERCLLRSGAAGPLGSVAQRSRPLEGSGQARCPEVIPPAPPTSLPTQPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823509 - protein, 222 aa, Homo sapiens
MRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823510 - protein, 466 aa, Homo sapiens
LAMAARGVIAPVGESCATLSTCSPRPNGQTPTSTSRDSIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823511 - protein, 182 aa, Homo sapiens [sequence omitted]

SEQ ID NO: 823512 - protein, 568 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEGTPSGCYPLAQVLTKTRPALPAQSGAASSLPWVREGPVCPADQLCPAGPVAALGSGAFCFDQADTPALQVSVALSGLGSSDCPHCGPPVNWGGSCTGVHPGSRPSRSASPAVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823513 - protein, 392 aa, Homo sapiens
MERWEGVCGRWRVQVKGVCLWQASARVLEGRSGGVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823514 - protein, 445 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823515 - protein, 222 aa, Homo sapiens; identical to SEQ ID NO: 823509

SEQ ID NO: 823516 - protein, 582 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEGSRPSRSASPAVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDCEYGESGSFGLPQGPGAWGPRTPARPTWHGGCWDAGSRRSLLSSPRSCQTGSQAWSTPESGQSLHPAFERCLLRSGAAGPLGSVAQRSRPLEGSGQARCPEVIPPAPPTSLPTQPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823517 - protein, 182 aa, Homo sapiens [sequence omitted]

SEQ ID NO: 823518 - protein, 144 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVLYSWHGPNPLTRQRNFE

SEQ ID NO: 823519 - protein, 104 aa, Homo sapiens
MVEDEVGIEIDQEVGATNGVLTEYLIVIYQCELAYFCLIMYIIHQKLVIIVEVRVRPVAGHVAITFVSDENDAKILNDVQDRFEVNVAELPEEIDISTYIEQSR

SEQ ID NO: 823520 - protein, 211 aa, Homo sapiens
MEVFVDDETKLTLHGLQQYYVKLKDSEKNRKLFDLLDVLEFNQVIIFVKSVQRCMALAQLLVEQNFPAIAIHRGMAQEERECEPPAKAAGSTTRSPVSDGLHLFLLHPSLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823521 - protein, 485 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYSKCLGQGQGSGAEGSSPGPSVHCISCLTVEQSR

SEQ ID NO: 823522 - protein, 442 aa, Homo sapiens
TRAPSSYGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823523 - protein, 276 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDCE

SEQ ID NO: 823524 - protein, 446 aa, Homo sapiens
MSVRDLSSALDMRVSCIIATMHVKVSLMCRSIPMMSRINFERARVNSPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823525 - protein, 567 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSPSGQTGPGATWFLQLFSLGSGPASIYQAWQGQLPLRFAVVLLLKSLMNYAWLPGACAGPSLGLPLSGAPGGSQACLGPLRPPVRRCWAVQVGALGRVSAWSGFLLIPIVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823526 - protein, 222 aa, Homo sapiens; identical to SEQ ID NO: 823509

SEQ ID NO: 823527 - protein, 222 aa, Homo sapiens; identical to SEQ ID NO: 823509

SEQ ID NO: 823528 - protein, 392 aa, Homo sapiens
GGRLLSGLHGRPAGGAPVVILGKALLLAEGCAVSEPEPNGTTGPKQAPVPPGRKGMHTYLWEYEASATCWVGSRPRLPSVSPDRAGGRWACVLGGSCSSHPSGCLCLRLPSLKRGSRRTGTAAPRQRVSGLQLLPRLRSLATPQPLRHQDWPLPRLTLPSSRCHWLPGTDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 823529 - protein, 182 aa, Homo sapiens [sequence omitted]

SEQ ID NO: 823530 - protein, 305 aa, Homo sapiens
AQQLVSERPAENRSWKCLLAARGEERGASIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKDEEVLKKNCPHVVVGTPGRILALVRNRSFSLKNVKHFVLDECDKMLEQLDMRRDVQEIFRLTPHEKQCMMFSACHAISSSRISSGGSWWPPICLAGGWTSSESTSSLTTTCLRTRTPTCTGWPGRVALAPKA

SEQ ID NO: 823531 - protein, 108 aa, Homo sapiens
AQQLVSERPAENRSWKCLLAARGEERGASIMAEQDVENDLLDYDEEDLILSACQVARAGRFGTKGLAITFVSDENDAKILNDVQDRFEVNVAELPEEIDISTYIEQSR

SEQ ID NO: 823532 - protein, 554 aa, Homo sapiens
LERPAQRCCRSRWKKRKKMALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 823533 - protein, 247 aa, Homo sapiens
GKTRPAVLSLALEEAEEDGAHQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKIYKKIPPGTNIFLQRRLKSFLSGR

SEQ ID NO: 823534 - protein, 412 aa, Homo sapiens
MNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 823535 - protein, 461 aa, Homo sapiens
MRNGPESQGKKSWDQNSCGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 823536 - protein, 407 aa, Homo sapiens
MKKKQKKKRRIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 823537 - protein, 447 aa, Homo sapiens
LERPAQRCCRSRWKKRKKMALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMPVDLRWRKMKF

SEQ ID NO: 823538 - protein, 47 aa, Homo sapiens
ITEKTRVALEKSVSQKVAAAMPVRAADKLAPAQYIRYESCLEDLVSF

SEQ ID NO: 823539 - protein, 448 aa, Homo sapiens
LERPAQRCCRSRWKKRKKMALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKGRNFREMKIGISVKLLLSVFLILGLPMKFSMTKGSSTNPRVWTVDLQVEKMKFIMFMIKPGEVVKIWPRVFIGPVKIWTRTCMVMT

SEQ ID NO: 823540 - protein, 541 aa, Homo sapiens
LERPAQRCCRSRWKKRKKMALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 823541 - protein, 554 aa, Homo sapiens; identical to SEQ ID NO: 823532

SEQ ID NO: 823542 - protein, 255 aa, Homo sapiens
LERPAQRCCRSRWKKRKKMALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKIYKKIPPGTNIFLQRRLKSFLSGR

SEQ ID NO: 823543 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 823544 - protein, 414 aa, Homo sapiens; identical to SEQ ID NO: 823543

SEQ ID NO: 823545 - protein, 261 aa, Homo sapiens
LNNKTEAKTFKTKSKSLILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 823546 - protein, 263 aa, Homo sapiens
SYTELFLDNSDLTRRHPAFILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 823547 - protein, 247 aa, Homo sapiens
MYLILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 823548 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 823549 - protein, 414 aa, Homo sapiens; identical to SEQ ID NO: 823543

SEQ ID NO: 823550 - protein, 165 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVLFVKTGI

SEQ ID NO: 823551 - protein, 258 aa, Homo sapiens
SILQYFAKMMRTKLILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 823552 - protein, 241 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKGYKPLSLFLPRCSVSLSYFKLIADLRV

SEQ ID NO: 823553 - protein, 88 aa, Homo sapiens
ASPARACALGDLSELAADLWCVLSRLSCAKMLQSIIKNIWIPMKPYYTKVYQEIWIGMGLMGFIVYKIRAADKRSKALKASAPAPGHH

SEQ ID NO: 823554 - protein, 58 aa, Homo sapiens
MLQSIIKNIWIPMKPYYTKVYQEIWIGMGLMGFIVYKIRAADKRSKALKASAPAPGHH

SEQ ID NO: 823555 - protein, 58 aa, Homo sapiens; identical to SEQ ID NO: 823554

SEQ ID NO: 823556 - protein, 129 aa, Homo sapiens
ASPARACALGDLSELAADLWCVLSRLSCAKMLQSIIKNIWIPMKPYYTKVYQEIWIGMGLMGFIVYKIRAAEMGFCHVTQAGLEFLGSSSPPILASQSAGINKREPQHLAQLGNFEQDFNIRIIKEVRL

SEQ ID NO: 823557 - protein, 107 aa, Homo sapiens
ASPARACALGDLSELAADLWCVLSRLSCAKMLQSIIKNIWIPMKPYYTKVYQEIWIGMGLMGFIVYKIRAADKRSKALKGKIFASENGWEWKTASCLFRTRYIVVLN

SEQ ID NO: 823558 - protein, 88 aa, Homo sapiens; identical to SEQ ID NO: 823553

SEQ ID NO: 823559 - protein, 88 aa, Homo sapiens; identical to SEQ ID NO: 823553

SEQ ID NO: 823560 - protein, 116 aa, Homo sapiens
MKLYGTRGSDISHFQCQMLQSIIKNIWIPMKPYYTKVYQEIWIGMGLMGFIVYKIRAAEMGFCHVTQAGLEFLGSSSPPILASQSAGINKREPQHLAQLGNFEQDFNIRIIKEVRL

SEQ ID NO: 823561 - protein, 88 aa, Homo sapiens; identical to SEQ ID NO: 823553

SEQ ID NO: 823562 - protein, 129 aa, Homo sapiens; identical to SEQ ID NO: 823556

SEQ ID NO: 823563 - protein, 107 aa, Homo sapiens; identical to SEQ ID NO: 823557

SEQ ID NO: 823564 - protein, 147 aa, Homo sapiens; identical to SEQ ID NO: 754319

SEQ ID NO: 823565 - protein, 69 aa, Homo sapiens
LGIAVPALLCPVTGLFALCSRVPQAATQWAHSQAALRPRAPSLCLSFPAVNILEALKLRKEEKSTENSL

SEQ ID NO: 823566 - protein, 147 aa, Homo sapiens; identical to SEQ ID NO: 754319

SEQ ID NO: 823567 - protein, 154 aa, Homo sapiens [sequence omitted]

SEQ ID NO: 823568 - protein, 69 aa, Homo sapiens; identical to SEQ ID NO: 823565

SEQ ID NO: 823569 - protein, 374 aa, Homo sapiens
MESLLQHLDRFSELLAVSSTTYVSTWDPATVRRALQWARYLRHIHRRFGRHGPIRTALERRLHNQWRQEGGFGRGPVPGLANFQALGHCDVLLSLRLLENRALGDAARYHLVQQLFPGPGVRDADEETLQESLARLARRRSAVHMLRFNGYRENPNLQEDSLMKTQAELLLERLQEVGKAEAERPARFLSSLWERLPQNNFLKVIAVALLQPPLSRRPQEELEPGIHKSPGEGSQVLVHWLLGNSEVFAAFCRALPAGLLTLVTSRHPALSPVYLGLLTDWGQRLHYDLQKGIWVGTESQDVPWEELHNRFQSLCQAPPPLKDKVLTALETCKAQDGDFEVPGLSIWTDLLLALRSGAFRKRQVLGLSAGLSSV

SEQ ID NO: 823570 - protein, 374 aa, Homo sapiens; identical to SEQ ID NO: 823569

SEQ ID NO: 823571 - protein, 374 aa, Homo sapiens; identical to SEQ ID NO: 823569

SEQ ID NO: 823572 - protein, 374 aa, Homo sapiens; identical to SEQ ID NO: 823569

SEQ ID NO: 823573 - protein, 374 aa, Homo sapiens; identical to SEQ ID NO: 823569

SEQ ID NO: 823574 - protein, 377 aa, Homo sapiens
AKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGS

SEQ ID NO: 823575 - protein, 439 aa, Homo sapiens
AKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGVSLKWGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 823576 - protein, 377 aa, Homo sapiens; identical to SEQ ID NO: 823574

SEQ ID NO: 823577 - protein, 221 aa, Homo sapiens
AKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKLGAQQLVDIYSYANSTETVKVDHRRYFDERNRRSRQGSTPADAIYACIQVELKRNHKQANL

SEQ ID NO: 823578 - protein, 381 aa, Homo sapiens
AKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 823579 - protein, 377 aa, Homo sapiens; identical to SEQ ID NO: 823574

SEQ ID NO: 823580 - protein, 273 aa, Homo sapiens
AKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRER

SEQ ID NO: 823581 - protein, 425 aa, Homo sapiens
LQRDGFLELRRLSVPLCSGPCPLTSLSRQGERSGGHLVAAARAAVTAETHPLPLLAPLAVCQSVKSPAACQVRPRPRAVALPAALGGPGRSLPGLTAATMSSFSESALEKKLSELSNSQQSVQTLSLWLIHHRKHAGPIVSVWHRELRKAKSNRKLTFLYLANDVIQNSKRKGPEFTREFESVLVDAFSHVAREADEGCKKPLERLLNIWQERSVYGGEFIQQLKLSMEDSKSPPPKATEEKKSLKRTFQQIQEEEDDDYPGSYSPQDPSAGPLLTEELIKALQDLENAASGDATVRQKIASLPQEVQDVSLLEKITDKEAAERLSKTVDEACLLLAEYNGRLAAELEDRRQLARMLVEYTQNQKDVLSEKEKKLEEYKQKLARVTQVRKELKSHIQSLPDLSLLPNVTGGLAPLPSAGDLFSTD

SEQ ID NO: 823582 - protein, 384 aa, Homo sapiens
LQRDGFLELRRLSVPLCSGPCPLTSLSRQGERSGGHLVAAARAAVTAETHPLPLLAPLAVCQSVKSPAACQVRPRPRAVALPAALGGPGRSLPGLTAATMSSFSESALEKKLSELSNSQQSVQTLSLWLIHHRKHAGPIVSVWHRELRKAKSNRKLTFLYLANDVIQNSKRKGPEFTREFESVLVDAFSHVAREADEGCKKPLERLLNIWQERSVYGGEFIQQLKLSMEDSKSPPPKATEEKKSLKRTFQQIQEEEDDDYPGSYSPQDPSAGPLLTEELIKALQDLENAASGDATVRQKIASLPQEVQDVSLLEKITDKEAAERLSKTVDEACLLLAEYNGRLAAELEDRRQLARMLVEYTQNQKDVLSEKEKKLEGVMIDFGL

SEQ ID NO: 823583 - protein, 425 aa, Homo sapiens; identical to SEQ ID NO: 823581

SEQ ID NO: 823584 - protein, 425 aa, Homo sapiens; identical to SEQ ID NO: 823581

SEQ ID NO: 823585 - protein, 425 aa, Homo sapiens; identical to SEQ ID NO: 823581

SEQ ID NO: 823586 - protein, 382 aa, Homo sapiens
MWSGPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 823587 - protein, 388 aa, Homo sapiens
MDSARLQSASPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 823588 - protein, 382 aa, Homo sapiens; identical to SEQ ID NO: 823586

SEQ ID NO: 823589 - protein, 382 aa, Homo sapiens
PGGGKKAPATSLPGTLQRDPQSGLASMDSSEEHAGCPARGTCPVFLAMSAGTVRYAPSGLCPVLEGNLREEPWGTDSPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 823590 - protein, 134 aa, Homo sapiens
PAPYHPACLPGLPQLSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 823591 - protein, 455 aa, Homo sapiens
PGGGKKAPATSLPGTLQRDPQSGLASMDSSEEHAGCPARGTCPVFLAMSAGTVRYAPSGLCPVLEGNLREEPWGTDSPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 823592 - protein, 392 aa, Homo sapiens
MWSGPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDGGLGRGPGLKGSSETEQTPTPLWPSCALFPVASLLDY

SEQ ID NO: 823593 - protein, 127 aa, Homo sapiens
MEAALSQHHTSILGQTGLDFTARPPSLPHWVLPPPGGFQESTKDQGARIHTRGASALGRGHLRQPAPPPQSPELPAGALLLACLQKGTVLGGWISRVPSTPAAKPWASSTPLWPSCALFPVASLLDY

SEQ ID NO: 823594 - protein, 427 aa, Homo sapiens
MWSGPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARSRSVANFSPTFVNSARLVPEDAKPCPRQLNVRQEMSGTTGLSPGVGAAGPEGNLYNGANRPQKATPDDAPDPPYLSECVPTIDSFRRTLRSADT

SEQ ID NO: 823595 - protein, 963 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823596 - protein, 963 aa, Homo sapiens; identical to SEQ ID NO: 823595

SEQ ID NO: 823597 - protein, 963 aa, Homo sapiens; identical to SEQ ID NO: 823595

SEQ ID NO: 823598 - protein, 939 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823599 - protein, 963 aa, Homo sapiens; identical to SEQ ID NO: 823595

SEQ ID NO: 823600 - protein, 963 aa, Homo sapiens; identical to SEQ ID NO: 823595

SEQ ID NO: 823601 - protein, 682 aa, Homo sapiens
MTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823602 - protein, 546 aa, Homo sapiens
FFLCVNKLKLFQTSLMTKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823603 - protein, 259 aa, Homo sapiens
SEMINLRENISLSIHHRAKYKALSSTLYTSSHQKQISSLRDEVEAKAKLITDLQDQNQKMMLEQERLRVEHEKLKATDQEKSRKLHELTVMQDRREQARQDLKGLEETVSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823604 - protein, 183 aa, Homo sapiens
SLVVTRTSDSRLLESDVLVSLDRGCELGRRSRESAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823605 - protein, 461 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQPSQHNFSRIFCPLHHFTPNS

SEQ ID NO: 823606 - protein, 973 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNSSFFFFFFFYSNGFYFPIMTFLTKRQVDGVKKNPPHEKVNKADPQKLPGKDVPLPRLAQFHQQLVSAQPYAFPLTPPPLHILVIQTRNFSADCVRVSEGGARWNLGTYWAPLMQMRKIENVKVDQSPLPPEGAETRDINQQHAGVKELRPLSSPLPRAGARPRTSSQAPHPRKATGSSPRLPHDATMTAYTSMSAEGEGECLEFSEVGNAKPTLEKPGKGQHSPQYKMKSDPEEIFKNKQTNKTKNTTPKPPFSQSRRRAKGSRPSPLRQHLWAQVSAEGARAPGSDSSVPSLHTEGDGSPGTESLSGPLSSPGGGFSPRFFAGASPRMEGGGLASGLRPRADGSTRALGSGSAARGPQKATTARTSTLSMLSAGRQAGFASHAGGAVGGAAGLQFRRPEKRLCRTRARLGKAPSACAGGGCRRSATSDDAPSSSSFSSRRAFLLGTSPASPPSLRLLLRRLRLTLAGRGAQQAEVSSAVGASCVSIGSGNGCSPSGVAVSAVDSASRGGCRRGSEGRAAGNDTSGSRASTLAEEVELPGAAHDQRQLQTPVQPQATALHAGVIHLPHRQGHDALCLFLHFHGDSTATAAGAPGRDRTGSRCTPDNGLAHASLHKPTHAVTL

SEQ ID NO: 823607 - protein, 944 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLRELAMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823608 - protein, 963 aa, Homo sapiens; identical to SEQ ID NO: 823595

SEQ ID NO: 823609 - protein, 888 aa, Homo sapiens
SGRPGRYAGGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823610 - protein, 643 aa, Homo sapiens
MAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823611 - protein, 494 aa, Homo sapiens [sequence omitted]

SEQ ID NO: 823612 - protein, 211 aa, Homo sapiens
SSCRIRQRKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 823613 - protein, 963 aa, Homo sapiens; identical to SEQ ID NO: 823595

SEQ ID NO: 823614 - protein, 963 aa, Homo sapiens; identical to SEQ ID NO: 823595

SEQ ID NO: 823615 - protein, 468 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 823616 - protein, 468 aa, Homo sapiens; identical to SEQ ID NO: 823615

SEQ ID NO: 823617 - protein, 468 aa, Homo sapiens; identical to SEQ ID NO: 823615

SEQ ID NO: 823618 - protein, 468 aa, Homo sapiens; identical to SEQ ID NO: 823615

SEQ ID NO: 823619 - protein, 263 aa, Homo sapiens
SRSPDLMIHPPRPPKVLGFQVLSQENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 823620 - protein, 468 aa, Homo sapiens; identical to SEQ ID NO: 823615

SEQ ID NO: 823621 - protein, 307 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGMSSTKKTVLSHRQLKDL

SEQ ID NO: 823622 - protein, 228 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKDLVRKEMGTQHYRISTAI

SEQ ID NO: 823623 - protein, 468 aa, Homo sapiens; identical to SEQ ID NO: 823615

SEQ ID NO: 823624 - protein, 468 aa, Homo sapiens; identical to SEQ ID NO: 823615

SEQ ID NO: 823625 - protein, 468 aa, Homo sapiens; identical to SEQ ID NO: 823615

SEQ ID NO: 823626 - protein, 468 aa, Homo sapiens; identical to SEQ ID NO: 823615

SEQ ID NO: 823627 - protein, 271 aa, Homo sapiens [sequence omitted]

SEQ ID NO: 823628 - protein, 125 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKVCTYTY

SEQ ID NO: 823629 - protein, 837 aa, Homo sapiens
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQARALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 823630 - protein, 88 aa, Homo sapiens
CSECTPPPSCDPQGRGGSLDGGLSVSPFHPLTHHCLLVAGNPQDTRLRYSFFVPRPTPSTPRPTPQDWLHRRAQILEILRRRPWAGRK

SEQ ID NO: 823631 - protein, 489 aa, Homo sapiens
MGKGPSDPIRAFAPTGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQARALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 823632 - protein, 451 aa, Homo sapiens
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPERCKLGSSKSAN

SEQ ID NO: 823633 - protein, 270 aa, Homo sapiens
MPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823634 - protein, 469 aa, Homo sapiens
VRPYIRCPPALGSSAVMLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823635 - protein, 469 aa, Homo sapiens; identical to SEQ ID NO: 823634

SEQ ID NO: 823636 - protein, 453 aa, Homo sapiens
CPALYPVSARPRLLRRDAVPIPLCVSGVQPLALRLPEGELPSRETFPACINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823637 - protein, 270 aa, Homo sapiens; identical to SEQ ID NO: 823633

SEQ ID NO: 823638 - protein, 398 aa, Homo sapiens
VRPYIRCPPALGSSAVMLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNETCLEIWVGDLHITRGRLGALWKPF

SEQ ID NO: 823639 - protein, 238 aa, Homo sapiens
ASNYVAVRYLAVISVRGAVCIFNVMLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVLTFDTRASRECPFVS

SEQ ID NO: 823640 - protein, 367 aa, Homo sapiens
MTWLQSKPQRLQNLSQREMSGGRKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823641 - protein, 469 aa, Homo sapiens; identical to SEQ ID NO: 823634

SEQ ID NO: 823642 - protein, 469 aa, Homo sapiens; identical to SEQ ID NO: 823634

SEQ ID NO: 823643 - protein, 270 aa, Homo sapiens; identical to SEQ ID NO: 823633

SEQ ID NO: 823644 - protein, 434 aa, Homo sapiens
VRPYIRCPPALGSSAVMLSRSRCVSRAFSRSLSAFQKGNCPLGRRSLPALTTVSSVFAFSELQLYARMTWLQSKPQRLQNLSQREMSGGRKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823645 - protein, 475 aa, Homo sapiens
VRPYIRCPPALGSSAVMLSRSRCVSRAFSRSLSAFQKGNCPLGRRSLPGVSLCQGPGYPNSRKVVINNSVFSVRFFRTTAVCKDDLVTVKTPAFAESVTEGDVRWEKAFDVFSAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823646 - protein, 143 aa, Homo sapiens
LQALSIDSVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 823647 - protein, 444 aa, Homo sapiens
VRPYIRCPPALGSSAVMLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDKQRGGVIGIYRSGAGQTQGVAGPPPENTRQPHETTGTTLDRNNTASAPTQGRPNSNCHRTMEEGHHHNTRPRSGAQETTSLNNTTAQGDANSTQHQTARTQQPTHKANQPTKGTPTTRATNYTT

SEQ ID NO: 823648 - protein, 230 aa, Homo sapiens
VRPYIRCPPALGSSAVMLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVLTFDTRASRECPFVS

SEQ ID NO: 823649 - protein, 440 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823650 - protein, 138 aa, Homo sapiens
MALKVSFFFLSFSSKIGKTLLAKAVANQTSATFLRVVGSELIQKYLGDGPKLVRELFRVAEEHAPSIVFIDEIDAIGTKRGRLSHTYFALFSREHRIALLLRMGNLRGLSLWPQFLLCVAFHACFRLCSPRSQLTTAQ

SEQ ID NO: 823651 - protein, 345 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPG

SEQ ID NO: 823652 - protein, 301 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKSAEPVGWI

SEQ ID NO: 823653 - protein, 422 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDDDVTLDDLIMAKDDLSGADIKAICTEAGLMALRERRMKVTNEDFKKSKENVLYKKQEGTPEGLYL

SEQ ID NO: 823654 - protein, 440 aa, Homo sapiens; identical to SEQ ID NO: 823649

SEQ ID NO: 823655 - protein, 440 aa, Homo sapiens; identical to SEQ ID NO: 823649

SEQ ID NO: 823656 - protein, 452 aa, Homo sapiens
NNVIGRVLGVITMGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823657 - protein, 450 aa, Homo sapiens
GCTGPNLWMQMGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823658 - protein, 449 aa, Homo sapiens
RYLRMGNGKMGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823659 - protein, 352 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRGRLSHTYFALFSREHRIALLLRMGNLRGLSLWPQFLLCVAFHACFRLCSPRSQLTTAQ

SEQ ID NO: 823660 - protein, 395 aa, Homo sapiens
AHEVPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823661 - protein, 389 aa, Homo sapiens
LTWIDCCVGNPLQGDEAEVRETGEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823662 - protein, 420 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823663 - protein, 226 aa, Homo sapiens [sequence omitted]

SEQ ID NO: 823664 - protein, 218 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKHESVELPSQHMLTIMTRDGS

SEQ ID NO: 823665 - protein, 129 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQERNRSQSWNGNFPFLWKKRGGGGLSFFKKIMPSWSTF

SEQ ID NO: 823666 - protein, 133 aa, Homo sapiens
AAYYYKIRGRSTDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823667 - protein, 440 aa, Homo sapiens; identical to SEQ ID NO: 823649

SEQ ID NO: 823668 - protein, 467 aa, Homo sapiens
NSPPHRQKRLVRAGVIGRGGSSVVKGKMGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823669 - protein, 452 aa, Homo sapiens
GTPPDGYGIQGKMGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823670 - protein, 448 aa, Homo sapiens
MYGLVVNRPGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823671 - protein, 457 aa, Homo sapiens
NKKNNRQRRLGYSAEGQTGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823672 - protein, 345 aa, Homo sapiens; identical to SEQ ID NO: 823651

SEQ ID NO: 823673 - protein, 440 aa, Homo sapiens
MRDEEDHRITWKSGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823674 - protein, 430 aa, Homo sapiens
RYLRMGKGKMGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823675 - protein, 270 aa, Homo sapiens
SVPPINIQAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823676 - protein, 132 aa, Homo sapiens
MLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 823677 - protein, 282 aa, Homo sapiens
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823678 - protein, 271 aa, Homo sapiens
MSDTEEQEYEEEQPEEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823679 - protein, 150 aa, Homo sapiens
MRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823680 - protein, 264 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKQNRSVVSGRSASLGDPARDRPS

SEQ ID NO: 823681 - protein, 66 aa, Homo sapiens
MSDTEEQEYEEEQPEEEAAEEEEEGRGQRPRSGERMRTFISRPVRYELSAERTQRAPVKASNRIST

SEQ ID NO: 823682 - protein, 346 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823683 - protein, 332 aa, Homo sapiens
PSSSSLTPRSPDPGVQAPSPSSLTPRSLGRPLLGAPPHWASSLWSLGRTRMSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823684 - protein, 361 aa, Homo sapiens
LRLGSEAGCVIGRGGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823685 - protein, 407 aa, Homo sapiens
LRLGSEAGCVIGRGGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSPPQLGPSTFRSLPGLAATSLDGTSRRWEVAQGGRATQWSLCFWPLSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823686 - protein, 257 aa, Homo sapiens
TTYFLEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823687 - protein, 335 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDDIHRKRMEKDLLELQTLIDVHFEQRKKEEEELVALKERIERRRSERAEQQRFRTEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823688 - protein, 282 aa, Homo sapiens; identical to SEQ ID NO: 823677

SEQ ID NO: 823689 - protein, 282 aa, Homo sapiens; identical to SEQ ID NO: 823677

SEQ ID NO: 823690 - protein, 281 aa, Homo sapiens
SKAQPQDSQHLRRSLGRTRMSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSYCVSLCHPGWSAVE

SEQ ID NO: 823691 - protein, 264 aa, Homo sapiens
LRLGSEAGCVIGRGGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSRPVVPPLIPPKIPEGERVDFDEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTNRIARQKVRKGAGRAALEALK

SEQ ID NO: 823692 - protein, 309 aa, Homo sapiens
LRLGSEAGCVIGRGGGEECGTLAGKGRLSPRALARPLRVWSVSSRHPCTARGNVPIAAEARGTPVQQRLEPWSLATAPIPPPAPNAFSSVPPSPEEAAEEEEEEEERPKPSPPQLGPSTFRSLPGLAATSLDGTSRRWEVAQGGRATQWSLCFWPLSRPVVPPLIPPKIPEGERVDFDDIHRKRMEKDLLELQTLIDVHFEQRKKEEEELVALKERIERRRSERAEQQRFRTEKERERQAKLALESEKFDLMAKLVNSRNMRSTCCTTASATPRSSGRGQGRAALEAAGSEDAAPDSGTWEAWECLSHR

SEQ ID NO: 823693 - protein, 174 aa, Homo sapiens
LRLGSEAGCVIGRGGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSPPQLGPSTFRSLPGLAATSLDGTSRRWEVAQGGRATHGLCVSGHSAAPWCLL

SEQ ID NO: 823694 - protein, 317 aa, Homo sapiens
SKAQPQDSQHLRRSLGRTRMSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLRARSAWLPPSQPSCPAREKAQELSDWIHQLESEKFDLMAKLVNSRNMRSTCCTTASATPRSSGRGQGRAALEAAGSEDAAPDSGTWEAWECLSHR

SEQ ID NO: 823695 - protein, 132 aa, Homo sapiens
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLARRR

SEQ ID NO: 823696 - protein, 357 aa, Homo sapiens
MGTRPGALGRGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823697 - protein, 347 aa, Homo sapiens
SKAQPQDSQHLRRSLGRTRMSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAVQANLLPQPPSSWDYRILRPREGGQVRWLTPVIPALREAEAGGSLEEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823698 - protein, 282 aa, Homo sapiens; identical to SEQ ID NO: 823677

SEQ ID NO: 823699 - protein, 396 aa, Homo sapiens
LRLGSEAGCVIGRGGGEECGTLAGKGRLSPRALARPLRVWSVSSRHPCTARGNVPIAAEARGTPVQQRLEPWSLATAPIPPPAPNAFSSVPPSPEEAAEEEEEAPEEPEPVAEPEEERPKPSPPQLGPSTFRSLPGLAATSLDGTSRRWEVAQGGRATQWSLCFWPLSRPVVPPLIPPKIPEGERVDFDDIHRKRMEKDLLELQTLIDVHFEQRKKEEEELVALKERIERRRSERAEQQRFRTEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHR

SEQ ID NO: 823700 - protein, 451 aa, Homo sapiens
SKAQPQDSQHLRRSLGRTRMSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLVNSRNMRSTCCTTASATPRSSGRGQGRAALEAAGSEDAAPDSGTWEAWECLSHVVNVQRLLTLGEDAHLHLPPRLPLTTLLFCLDQVAAKWAPMLDSTFFFLASSSARFLASSSSFLIFSSASFSLTFAFLLSSEALLLGSLCPAPLNALLQGNQLLFLLLPLLEMYIDECLQLQQVFLHALAVDVIEVNALPFWIFGGTSSRS

SEQ ID NO: 823701 - protein, 317 aa, Homo sapiens; identical to SEQ ID NO: 823694

SEQ ID NO: 823702 - protein, 208 aa, Homo sapiens
SKAQPQDSQHLRRSLGRTRMSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKQNRSVVSGRSASLGDPARDRPS

SEQ ID NO: 823703 - protein, 150 aa, Homo sapiens
LYPSVFGMAPSRQPRRSSQRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPVSPQGWGRIPRTPREGGDNRKASREWPPWEGASLL

SEQ ID NO: 823704 - protein, 689 aa, Homo sapiens
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 823705 - protein, 689 aa, Homo sapiens; identical to SEQ ID NO: 823704

SEQ ID NO: 823706 - protein, 306 aa, Homo sapiens [sequence omitted]

SEQ ID NO: 823707 - protein, 678 aa, Homo sapiens
TSPFRGPPGAAGARRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 823708 - protein, 618 aa, Homo sapiens
MAAATASPRSLLVLLQVVVLALAQIRGPPGERGPPGPPGPPGVPGSDGIDGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 823709 - protein, 128 aa, Homo sapiens
PALQSGIELLPNSLIPLHVSLKAPTFLPHVPKSKRHQLGAPSPGSGSHSWHLMTSACLYLLACCCHPLQPGQGYSHAPVICFWFLFLRKRGLFSQRLQGLGDLDRREESEESLWERPARACVCPLGVV

SEQ ID NO: 823710 - protein, 689 aa, Homo sapiens; identical to SEQ ID NO: 823704

SEQ ID NO: 823711 - protein, 689 aa, Homo sapiens; identical to SEQ ID NO: 823704

SEQ ID NO: 823712 - protein, 689 aa, Homo sapiens
YPPTDKELLFSPPAAAHSEASSPSSPFPSLWGRRRLNPSPCLWHIWTLLQGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 823713 - protein, 781 aa, Homo sapiens
PALQSGIELLPNSLIPLHVSLKAPTFLPHVPKSKRHQLGAPSPGSGSHSWHLMTSACLYLLACCCHPLQPGQGYSHAPVICFWFLFLRKRGLFSQRLQGLGDLDRREESEESLWELACQGLCVPTWGSVSRSVLSPPTCILQGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 823714 - protein, 523 aa, Homo sapiens
YPPTDKELLFSPPAAAHSEASSPSSPFPSLWGRRRLNPSPCLWHIWTLLQGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVESNWQRSP

SEQ ID NO: 823715 - protein, 272 aa, Homo sapiens
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPVSARAEEPLYSLKSLDAPYLGPFPYPSLQHSQRWSTGGFQHHREADDSQISCSYTSFLLTAI

SEQ ID NO: 823716 - protein, 411 aa, Homo sapiens
SAAAGPGPAPRGSASRLGARHGDGGSAGLGGRPCIMETLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 823717 - protein, 411 aa, Homo sapiens; identical to SEQ ID NO: 823716

SEQ ID NO: 823718 - protein, 411 aa, Homo sapiens; identical to SEQ ID NO: 823716

SEQ ID NO: 823719 - protein, 376 aa, Homo sapiens; identical to SEQ ID NO: 739727

SEQ ID NO: 823720 - protein, 111 aa, Homo sapiens
MGDVLRLKSQQLFPAFLLGVFTTDALFRQWVSRDALSSLKQYHLISRERRGDLCLPTSSFPGMPSALLRGFSRNISSKSFWKLPMCPMSALPALSRPFWLLLTCPCIVTEC

SEQ ID NO: 823721 - protein, 411 aa, Homo sapiens; identical to SEQ ID NO: 823716

SEQ ID NO: 823722 - protein, 276 aa, Homo sapiens
MCVCAEDGKTLPVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLHELLKWRMTLNWKNHETVLNHHNLMKATTNTHPYAGGGFEIHSMWFCMMQQMELMGRYQTSLYEWRRSPLGTPKRTYAYIKSNAALKDEAGNGSDAKNRRLTKEETLKKGHEKRPEGTTMTTGRQRIWEVNEETHTSLHVT

SEQ ID NO: 823723 - protein, 1138 aa, Homo sapiens
LPHGRTRGPGPAMAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCGFRGILIES

SEQ ID NO: 823724 - protein, 1069 aa, Homo sapiens
LPHGRTRGPGPAMAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQALFRMLVLGVCISSCGQGRPREDFKFKSAGIFV

SEQ ID NO: 823725 - protein, 951 aa, Homo sapiens
LPHGRTRGPGPAMAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILINPARTL

SEQ ID NO: 823726 - protein, 121 aa, Homo sapiens
CRGVQWGGPFNSLCSELCFCLLRWLSLLKTCRGSICDSCFDIGHLWNVSTILNGISAPPPKGRRMEELGGPCIIFFPDPTMLFPAKDKGEKNFAMSYVKLMKEDGTTLHDGFHDLVVLKVP

SEQ ID NO: 823727 - protein, 1842 aa, Homo sapiens
LPHGRTRGPGPAMAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCEYQRSGDFKKFENEIILKLDHEVEGGRGDEQYMQLLESILMECAAEHPTIAKSVENFVNLVKGLLEKLLDYRGVMTDESKDNRMSCTVNLLNFYKDNNREEMYIRYLYKLRDLHLDCDNYTEAAYTLLLHTWLLKWSDEQCASQVMQTGQQHPQTHRQLKETLYETIIGYFDKGKMWEEAISLCKELAEQYEMEIFDYELLSQNLIQQAKFYESIMKILRPKPDYFAVGYYGQGFPSFLRNKVFIYRGKEYERREDFQMQLMTQFPNAEKMNTTSAPGDDVKNAPGQYIQCFTVQPVLDEHPRFKNKPVPDQIINFYKSNYVQRFHYSRPVRRGTVDPENEFASMWIERTSFVTAYKLPGILRWFEVVHMSQTTISPLENAIETMSTANEKILMMINQYQSDETLPINPLSMLLNGIVDPAVMGGFAKYEKAFFTEEYVRDHPEDQDKLTHLKDLIAWQIPFLGAGIKIHEKRVSDNLRPFHDRMEECFKNLKMKVEKEYGVREMPDFDDRRVGRPRSMLRSYRQMSIISLASMNSDCSTPSKPTSESFDLELASPKTPRVEQEEPISPGSTLPEVKLRRSKKRTKRSSVVFADEKAAAESDLKRLSRKHEFMSDTNLSEHAAIPLKASVLSQMSFASQSMPTIPALALSVAGIPGLDEANTSPRLSQTFLQLSDGDKKTLTRKKVNQFFKTMLASKSAEEGKQIPDSLSTDL

SEQ ID NO: 823728 - protein, 1842 aa, Homo sapiens; identical to SEQ ID NO: 823727

SEQ ID NO: 823729 - protein, 957 aa, Homo sapiens
LPHGRTRGPGPAMAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILIGACCNCGFPSST

SEQ ID NO: 823730 - protein, 137 aa, Homo sapiens
QLPGYSRGTMFSKGHKTSLPSKLPCQESLCKSHSYGAQNTDLDFKCTTRDSARPEVYCNEPPWTVQGQIGCQQPGMATRSLSLFLSFSFYKSNYVQRFHYSRPVRRGTVDPENEFAVSIFPTLDHSLEPPGGTRACI

SEQ ID NO: 823731 - protein, 418 aa, Homo sapiens
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 823732 - protein, 418 aa, Homo sapiens; identical to SEQ ID NO: 823731

SEQ ID NO: 823733 - protein, 418 aa, Homo sapiens; identical to SEQ ID NO: 823731

SEQ ID NO: 823734 - protein, 415 aa, Homo sapiens
MASPGSDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 823735 - protein, 418 aa, Homo sapiens; identical to SEQ ID NO: 823731

SEQ ID NO: 823736 - protein, 418 aa, Homo sapiens; identical to SEQ ID NO: 823731

SEQ ID NO: 823737 - protein, 418 aa, Homo sapiens; identical to SEQ ID NO: 823731

SEQ ID NO: 823738 - protein, 313 aa, Homo sapiens
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFRRGSPKLTKIPYVISIWLGKNQSGGQYQSTPGSAGQEKHPGVCGFTPGSGCERPKIRKM

SEQ ID NO: 823739 - protein, 144 aa, Homo sapiens
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEEVENGFWRAQKAPGLPTVLL

SEQ ID NO: 823740 - protein, 392 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 823741 - protein, 392 aa, Homo sapiens; identical to SEQ ID NO: 823740

SEQ ID NO: 823742 - protein, 218 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKIKVISLS

SEQ ID NO: 823743 - protein, 392 aa, Homo sapiens; identical to SEQ ID NO: 823740

SEQ ID NO: 823744 - protein, 392 aa, Homo sapiens; identical to SEQ ID NO: 823740

SEQ ID NO: 823745 - protein, 353 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQQLEDTGD

SEQ ID NO: 823746 - protein, 392 aa, Homo sapiens; identical to SEQ ID NO: 823740

SEQ ID NO: 823747 - protein, 75 aa, Homo sapiens
CTKPSGWKAQWPAPRLVASRPPRQGCTSVSLVLLLTGQTARSPLPAAALTGTDDFAGKCGGQLCLSVDGSSAIPA

SEQ ID NO: 823748 - protein, 75 aa, Homo sapiens; identical to SEQ ID NO: 823747

SEQ ID NO: 823749 - protein, 153 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 823750 - protein, 153 aa, Homo sapiens; identical to SEQ ID NO: 823749

SEQ ID NO: 823751 - protein, 137 aa, Homo sapiens
MITPTVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 823752 - protein, 104 aa, Homo sapiens
MRPLCLICADKPTGYGSSSRRAPQTGIVDECCFRSCDLRRLEMYCAPLKPAKSARSVRAQRHTDMPKTQKVSPPGWDPAILKWSLSCACGWAKQKSCPIVSWLT

SEQ ID NO: 823753 - protein, 195 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 823754 - protein, 153 aa, Homo sapiens; identical to SEQ ID NO: 823749

SEQ ID NO: 823755 - protein, 341 aa, Homo sapiens
TEAAGGAAGGGGAAAERSIMADRDSGSEQGGAALGSGGSLGHPGSGSGSGGGGGGGGGGGGSGGGGGGAPGGLQHETQELASKRVDIQNKRFYLDVKQNAKGRFLKIAEVGAGGNKSRLTLSMSVAVEFRDYLGDFIEHYAQLGPSQPPDLAQAQDEPRRALKSEFLVRENRKYYMDLKENQRGRFLRIRQTVNRGPGLGSTQGQTIALPAQGLIEFRDALAKLIDDYGVEEEPAELPEGTSLTVDNKRFFFDVGSNKYGVFMRVSEVKPTYRNSITVPYKVWAKFGHTFCKYSEEMKKIQEKQREKRAACEQLHQQQQQQQEETAAATLLLQGEEEGEED

SEQ ID NO: 823756 - protein, 341 aa, Homo sapiens; identical to SEQ ID NO: 823755

SEQ ID NO: 823757 - protein, 341 aa, Homo sapiens; identical to SEQ ID NO: 823755

SEQ ID NO: 823758 - protein, 322 aa, Homo sapiens
TEAAGGAAGGGGAAAERSIMADRDSGSEQGGAALGSGGSLGHPGSGSGSGGGGGGGGGGGGSGGGGGGAPGGLQHETQELASKRVDIQNKRFYLDVKQNAKGRFLKIAEVGAGGNKSRLTLSMSVAVEFRDYLGDFIEHYAQLGPSQPPDLAQAQDEPRRALKSEFLVRENRKYYMDLKENQRGRFLRIRQTVNRGPGLGSTQGQTIALPAQGLIEFRDALAKLIDDYGVEEEPAELPEGTSLTVDNKRFFFDVGSNKYGVFMRVSEVKPTYRNSITVPYKVWAKFGHTFCKYSEEMKKIQEKQREKRSPPAAAVAAGEAAS

SEQ ID NO: 823759 - protein, 341 aa, Homo sapiens; identical to SEQ ID NO: 823755

SEQ ID NO: 823760 - protein, 341 aa, Homo sapiens; identical to SEQ ID NO: 823755

SEQ ID NO: 823761 - protein, 156 aa, Homo sapiens
MPVAAICGTFGKVKGDAFQHCSVTLDEPTVDYVLVHGWLIDDYGVEEEPAELPEGTSLTVDNKRFFFDVGSNKYGVFMRVSEVKPTYRNSITVPYKVWAKFGHTFCKYSEEMKKIQEKQREKRAACEQLHQQQQQQQEETAAATLLLQGEEEGEED

SEQ ID NO: 823762 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 823763 - protein, 323 aa, Homo sapiens; identical to SEQ ID NO: 823762

SEQ ID NO: 823764 - protein, 301 aa, Homo sapiens
MVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 823765 - protein, 112 aa, Homo sapiens
MNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 823766 - protein, 323 aa, Homo sapiens; identical to SEQ ID NO: 823762

SEQ ID NO: 823767 - protein, 323 aa, Homo sapiens; identical to SEQ ID NO: 823762

SEQ ID NO: 823768 - protein, 323 aa, Homo sapiens; identical to SEQ ID NO: 823762

SEQ ID NO: 823769 - protein, 323 aa, Homo sapiens; identical to SEQ ID NO: 823762

SEQ ID NO: 823770 - protein, 140 aa, Homo sapiens
EHRARYPAIYSMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLSAFPPDHSAAAKVSSYDPFVPDATS

SEQ ID NO: 823771 - protein, 1094 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823772 - protein, 1094 aa, Homo sapiens; identical to SEQ ID NO: 823771

SEQ ID NO: 823773 - protein, 1094 aa, Homo sapiens; identical to SEQ ID NO: 823771

SEQ ID NO: 823774 - protein, 1094 aa, Homo sapiens; identical to SEQ ID NO: 823771

SEQ ID NO: 823775 - protein, 728 aa, Homo sapiens
MLLLLGFGERGRASWSAVLSCWDTAWALVLTEWLIVIFQTPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823776 - protein, 961 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLVRLRVGV

SEQ ID NO: 823777 - protein, 1022 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGVFCQFWIIHCPRRFEASLIAYGHRDPGT

SEQ ID NO: 823778 - protein, 1094 aa, Homo sapiens; identical to SEQ ID NO: 823771

SEQ ID NO: 823779 - protein, 1094 aa, Homo sapiens; identical to SEQ ID NO: 823771

SEQ ID NO: 823780 - protein, 255 aa, Homo sapiens
SVGTSSTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823781 - protein, 1094 aa, Homo sapiens; identical to SEQ ID NO: 823771

SEQ ID NO: 823782 - protein, 1094 aa, Homo sapiens; identical to SEQ ID NO: 823771

SEQ ID NO: 823783 - protein, 1094 aa, Homo sapiens; identical to SEQ ID NO: 823771

SEQ ID NO: 823784 - protein, 426 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLEQASNRVLSRAFSASPPSVRSPVV

SEQ ID NO: 823785 - protein, 1094 aa, Homo sapiens; identical to SEQ ID NO: 823771

SEQ ID NO: 823786 - protein, 75 aa, Homo sapiens
TRGSGRVGRGRVGRPTRPRQESEWGSILCGLSLSYAQGDSAATELKQVGKWHRAQASFQKAPQDVREIGTVTYLM

SEQ ID NO: 823787 - protein, 110 aa, Homo sapiens
ESYRTEVFPEVNDRVSGLTEEMKLGVMKLWVVEKVASLGNNVTFYREGGAEESAIRVGFVTYNKVLHFYNVKSSLAQPQMMVVSDVADMFVPLLDGFLVNVNESRAVITR

SEQ ID NO: 823788 - protein, 101 aa, Homo sapiens
SFLFLRLSSLCVLCLRGLRLDVLTLQCMYICLLARLYDNVRDVVENLVRGLDGDKTVTVEFKHDDRLNEESGALLQALLYTSCAGGRREAGLGRKCFIRLV

SEQ ID NO: 823789 - protein, 1094 aa, Homo sapiens; identical to SEQ ID NO: 823771

SEQ ID NO: 823790 - protein, 1009 aa, Homo sapiens
MVGNQGPQPPPFPMEPTMAQYQAISKHLPKVCQEPHLPRGHLQPQQHRLLVARLHMASLAKEMYRMGQAPLFRCKGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823791 - protein, 1042 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLVRAGSQGEYGCGSILCETIGSQYS

SEQ ID NO: 823792 - protein, 710 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQWRTTRSGS

SEQ ID NO: 823793 - protein, 1094 aa, Homo sapiens; identical to SEQ ID NO: 823771

SEQ ID NO: 823794 - protein, 961 aa, Homo sapiens; identical to SEQ ID NO: 823776

SEQ ID NO: 823795 - protein, 255 aa, Homo sapiens
EHRARYPAIYSMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823796 - protein, 228 aa, Homo sapiens
MLFNLCALVPGLLTRLVTASYRSSVPESPTLAERLACLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823797 - protein, 94 aa, Homo sapiens
LHNVCPYVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 823798 - protein, 163 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQRQLERRSLLLGHRLGFGID

SEQ ID NO: 823799 - protein, 115 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLQVLLTSSPVDY

SEQ ID NO: 823800 - protein, 277 aa, Homo sapiens [sequence omitted]

SEQ ID NO: 823801 - protein, 703 aa, Homo sapiens
MLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLP

SEQ ID NO: 823802 - protein, 555 aa, Homo sapiens
MLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTYEEEEVTAEVLIFRGAAFKQGEKKEWRVTMMYNHSGYDLA

SEQ ID NO: 823803 - protein, 350 aa, Homo sapiens
MLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEGQ

SEQ ID NO: 823804 - protein, 325 aa, Homo sapiens
MSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLP

SEQ ID NO: 823805 - protein, 1012 aa, Homo sapiens
CRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYKMKYGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETR

SEQ ID NO: 823806 - protein, 692 aa, Homo sapiens
MLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPSSSYYQNQQPSANFQNYNQLKGSLSQQTVFSSSP

SEQ ID NO: 823807 - protein, 325 aa, Homo sapiens; identical to SEQ ID NO: 823804

SEQ ID NO: 823808 - protein, 454 aa, Homo sapiens
KRKKKLLLFLCVPNCLPPLLFVHPWAESVHPCTLFAPLYGYLWVLTISAPLLPLSLSVLGSPSVHPYTLPLLSSAYLSVCLEPSTPLISTSSMVLKLMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLP

SEQ ID NO: 823809 - protein, 556 aa, Homo sapiens
RALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPLLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVSLGHRSPLLVFIPYLGCCVVN

SEQ ID NO: 823810 - protein, 105 aa, Homo sapiens
SCPPGSNGLALVLQHDPLVPLSASIELILVEDVRVSPEEVTIYNHPGIQAELRIREGSGYFFLNTSTADVVKVAYQEARGVAMVSLGHRSPLLVFIPYLGCCVVN

SEQ ID NO: 823811 - protein, 1476 aa, Homo sapiens
RALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPLLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVSDPAAGSQGPLSTTLTFSSPVTNQAIAIPVTVAFVMDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 823812 - protein, 672 aa, Homo sapiens
MLVGTVDSRAAHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVSDPAAGSQGPLSTTLTFSSPVTNQAIAIPVTVAFVMDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 823813 - protein, 1476 aa, Homo sapiens; identical to SEQ ID NO: 823811

SEQ ID NO: 823814 - protein, 155 aa, Homo sapiens
IPRVIPFTPSGPRTVLEENVLEMQQESYSLSTTLTFSSPVTNQAIAIPVTVAFVMDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 823815 - protein, 113 aa, Homo sapiens
SLPHCLHAPGSCCACSPHASSQPWTQPPLFRCLITHISQCIASCSQSQPSLRAVEPSLCLPLGRVKVPGGWVSAEPRAPPRWNIPAAFTLEQAPPDECPGPRPASLPSLHTEL

SEQ ID NO: 823816 - protein, 1476 aa, Homo sapiens; identical to SEQ ID NO: 823811

SEQ ID NO: 823817 - protein, 1476 aa, Homo sapiens; identical to SEQ ID NO: 823811

SEQ ID NO: 823818 - protein, 1384 aa, Homo sapiens
RALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPLLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVSDPAAGSQGPLSTTLTFSTLPGFLPGHVLHALRPVGWDSGHDHR

SEQ ID NO: 823819 - protein, 556 aa, Homo sapiens; identical to SEQ ID NO: 823809

SEQ ID NO: 823820 - protein, 70 aa, Homo sapiens
MIPVSAADDENEFQTGDGACLTTSPHKRGEDVGLGCPAPARAALEECQVFCLFCPQAVDPSSVALVTLGS

SEQ ID NO: 823821 - protein, 76 aa, Homo sapiens
MADGASLFQHFLDSYQVMFFTLFALLAGTAVMIIGEEAACISGSVPLPRPALTNPVLLQPTTLSARPGILLCLQPS

SEQ ID NO: 823822 - protein, 79 aa, Homo sapiens
AAANWEHDDLNGTAWAVDAGMGSKNEGGQLVILDNRYSDFMTMAYPTPSHDSKQSLRLGLSVTDMLTLPRLYGDGVGLV

SEQ ID NO: 823823 - protein, 681 aa, Homo sapiens
YAIVDQRSPRVEVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVSDPAAGSQGPLSTTLTFSSPVTNQAIAIPVTVAFVMDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 823824 - protein, 507 aa, Homo sapiens [sequence omitted]

SEQ ID NO: 823825 - protein, 187 aa, Homo sapiens
MLDVDQEDPTGICAPEVLENLEVKSGSPAVLAFAKEKSFGWPSFITYTVGVSDPAAGSQGPLSTTLTFSSPVTNQAIAIPVTVAFVMDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 823826 - protein, 173 aa, Homo sapiens
PQLCCLFQVKSGSPAVLAFAKEKSFGWPSFITYTVGVSDPAAGSQGPLSTTLTFSSPVTNQAIAIPVTVAFVMDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 823827 - protein, 140 aa, Homo sapiens
GGHGCSGSSRLCCLLQLLWQQVPALSSCLSQRAPPWVLGATPGSLQGLRSTAESLLPSGSLFLWRSCPRLHCIQMHGASLPHAPWTDAAVVLKLETRSPRKALRSWVLGWHPRPLCVNEASSEGARGLPSAGRGGLGASL

SEQ ID NO: 823828 - protein, 1476 aa, Homo sapiens; identical to SEQ ID NO: 823811

SEQ ID NO: 823829 - protein, 462 aa, Homo sapiens
RALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPLLDLAAYDQEGRRFDNFSSLSIQWESTRPVLASIEPELPMQLVCRPFWFTRHQEPQPSLPLPLATRSPTSALPEQSSRMTLWCLCRPP

SEQ ID NO: 823830 - protein, 125 aa, Homo sapiens
RALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIVGL

SEQ ID NO: 823831 - protein, 129 aa, Homo sapiens
MAPGGWSQEHDRHWGRQRGCLLRLLSEPPWGYGSQRGSWPVIQVSWALTGVSSYGKGADTCASSPGLSGTWSSSANSILHIDPKTGVAVARAVGSVTVYYEVAGHLRTYKEVGSKQPEAHVAQWPVRRA

SEQ ID NO: 823832 - protein, 130 aa, Homo sapiens
SRRTLQMKACATKPEELSVHNNVSTQSNGSQQAWGMRSALPVSPSISSAPVPVEIENLPQSPGTDQHDRKWLSAASDCCQRGGNQWNTRALPPPQTAHRNYTDFVHEHNVKNAGIRHDVHFPGHTAMTEI

SEQ ID NO: 823833 - protein, 719 aa, Homo sapiens
MRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLETTIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPSGAMSNGLAGCEMLLTGKEGHGNKDGISLISPPAPFLVDAVTSSGPILAEEAVLKQKCLLTTEL

SEQ ID NO: 823834 - protein, 719 aa, Homo sapiens; identical to SEQ ID NO: 823833

SEQ ID NO: 823835 - protein, 123 aa, Homo sapiens [sequence omitted]

SEQ ID NO: 823836 - protein, 674 aa, Homo sapiens
MRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLETTIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPLWSHFGRRSCPEAEVFTDH

SEQ ID NO: 823837 - protein, 674 aa, Homo sapiens; identical to SEQ ID NO: 823836

SEQ ID NO: 823838 - protein, 492 aa, Homo sapiens [sequence omitted]

SEQ ID NO: 823839 - protein, 732 aa, Homo sapiens
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 823840 - protein, 676 aa, Homo sapiens
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKFKIGGEWWTWIDYNRFQELIQEYEDSGGSKTFSAKDYMARTPHWALFGASERGFDPKDTRHQRKNKSKAISGC

SEQ ID NO: 823841 - protein, 346 aa, Homo sapiens
MLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 823842 - protein, 258 aa, Homo sapiens
MTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 823843 - protein, 684 aa, Homo sapiens
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKTAVPGLERSEAVCCKRSGHVRAWSH

SEQ ID NO: 823844 - protein, 71 aa, Homo sapiens
SSVPRSTDVFALRVHLQPEHIPAFGPVGGEALQVDKGIFFVFIQYVYYMQLLNSYYYTLSINLLFRGIIYI

SEQ ID NO: 823845 - protein, 475 aa, Homo sapiens
PGDSRREVVVRMVRRKDLKSRTNGITETPREEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 823846 - protein, 732 aa, Homo sapiens; identical to SEQ ID NO: 823839

SEQ ID NO: 823847 - protein, 1070 aa, Homo sapiens
PASVHPSVRPTVQRKGLQAGRTSTRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 823848 - protein, 678 aa, Homo sapiens
MMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 823849 - protein, 1004 aa, Homo sapiens
PASVHPSVRPTVQRKGLQAGRTSTRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGRCHWERSVSSCSSNQGATHSERQGYQQHLYSSGPLGEYGCHVSIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 823850 - protein, 286 aa, Homo sapiens
MPMIQNRCSVPLVNNNDVTKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 823851 - protein, 1084 aa, Homo sapiens
PASVHPSVRPTVQRKGLQAGRTSTRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSERLSPEHLISKKDFISHPSLK

SEQ ID NO: 823852 - protein, 246 aa, Homo sapiens
PASVHPSVRPTVQRKGLQAGRTSTRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSTQTILRNLLENSGWITQYTPYQPEVSQGRLESLLNYQTMVCDITGLDMANASLLDEGTAAAEALQLCYSPS

SEQ ID NO: 823853 - protein, 941 aa, Homo sapiens
PASVHPSVRPTVQRKGLQAGRTSTRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVLVFSLADGRGRDGDAGGDQGLDGLCKCLLLHSNEKSAVLPLTRVYSTPPITNREKSPFSNSSLCKKLNELFMVVVRVLLAEPACLFLPNLPSPSRLPHLIIKMAVTLTHLRVRNCNTNVSFANIHDCASPIMLNSWHHAAWFPPTPTLNLPTSRKKLLSNRICFPPADWQLHLKREGNQWNSNVILMVVLLGMETVNSVQLPSKGS

SEQ ID NO: 823854 - protein, 291 aa, Homo sapiens
MKARRPNRDPFLLVFASGAQGEYAGLATIRAYLNQKGEGHRTVCLIPKSAHGTNPASAHMAGMKIQPVEVDKYGNIDAVHLKAMVLVFSLADGRGRDGDAGGDQGLDGLCKCLLLHSNEKSAVLPLTRVYSTPPITNREKSPFSNSSLCKKLNELFMVVVRVLLAEPACLFLPNLPSPSRLPHLIIKMAVTLTHLRVRNCNTNVSFANIHDCASPIMLNSWHHAAWFPPTPTLNLPTSRKKLLSNRICFPPADWQLHLKREGNQWNSNVILMVVLLGMETVNSVQLPSKGS

SEQ ID NO: 823855 - protein, 1056 aa, Homo sapiens
PASVHPSVRPTVQRKGLQAGRTSTRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 823856 - protein, 420 aa, Homo sapiens
MKARRPNRDPFLLVFASGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 823857 - protein, 1070 aa, Homo sapiens; identical to SEQ ID NO: 823847

SEQ ID NO: 823858 - protein, 108 aa, Homo sapiens
NLGLKQLSCTGYVGHEFILDTRPFKKSANIEAVDVAKRLQDYGFHAPTMSWPVAGTLMVEPTESEDKAELDRFCDAMISIRQEIADIEEGRIDPRVNPLKVRRPWNIA

SEQ ID NO: 823859 - protein, 1182 aa, Homo sapiens
MGLLTFRDVAIEFSPEEWQCLDTAQQNLYRNVMLENYRNLAFLGIALSKPDLITYLEQGKEPWNMKQHEMVDEPTGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKGFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 823860 - protein, 1182 aa, Homo sapiens; identical to SEQ ID NO: 823859

SEQ ID NO: 823861 - protein, 1092 aa, Homo sapiens
MEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKGFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 823862 - protein, 889 aa, Homo sapiens
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 823863 - protein, 493 aa, Homo sapiens [sequence omitted]

SEQ ID NO: 823864 - protein, 472 aa, Homo sapiens
MRSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 823865 - protein, 101 aa, Homo sapiens
TFAPLWEVFRVSSDKLALCHLELTRKLQDLIKDVLRYGEEQLKTHKKVCVVGAAQRLGGCGTPAAHRTPDLLGLYNLRMSASENSVNSTTSSPGSYGPERC

SEQ ID NO: 823866 - protein, 215 aa, Homo sapiens
MKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGM

SEQ ID NO: 823867 - protein, 889 aa, Homo sapiens; identical to SEQ ID NO: 823862

SEQ ID NO: 823868 - protein, 952 aa, Homo sapiens
RAAAAEGGAGRAPVSATKPQVAASAGLGPSSGDGETEARSWTVTQTPDRHWTGPAGVSTETIRMSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 823869 - protein, 494 aa, Homo sapiens
LWRGKSPEGVALGACTRTLNGGPPDLPSTWPWPAGGWAGTLSGRGSELTARFPPQGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 823870 - protein, 456 aa, Homo sapiens
LWRGKSPEGVALGACTRTLNGGPPDLPSTWPWPAGGWAGTLSGRGSELTARFPPQGSSSLGFTSSPSPFSSSSPENVEDSGLDSPSHAAPGPSPDSWVPRPGTPQSPPSCRAPPPEARVSGHRLCQTRRSPSPRLQAPGGWRPWPEESRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 823871 - protein, 252 aa, Homo sapiens
ESQLIAGPPGARRVPGRPGSGDPLHPEEPPAHSVPSPAAGTMGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRLFDVGGSLGAKKWSTRGY

SEQ ID NO: 823872 - protein, 302 aa, Homo sapiens
MKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSEPKKWIHCFEGVTCIIFIAALSAYDMVLVEDDEVNRMHESLHLFNSICNHRYFATTSIVLFLNKKDVFFEKIKKAHLSICFPDYDGPNTYEDAGNYIKVQFLELNMRRDVKEIYSHMTCATDTQNVKFVFDAVTDIIIKENLKDCGLF

SEQ ID NO: 823873 - protein, 391 aa, Homo sapiens
ESQLIAGPPGARRVPGRPGSGDPLHPEEPPAHSVPSPAAGTMGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSEPKKWIHCFEGVTCIIFIAALSAYDMVLVEDDEVNRMHESLHLFNSICNHRYFATTSIVLFLNKKDVFFEKIKKAHLSICFPDYDGPNTYEDAGNYIKVQFLELNMRRDVKEIYSHMTCATDTQNVKFVFDAVTDIIIKENLKDCGLF

SEQ ID NO: 823874 - protein, 331 aa, Homo sapiens
KELIPSEPPGDTCTPSGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSEPKKWIHCFEGVTCIIFIAALSAYDMVLVEDDEVNRMHESLHLFNSICNHRYFATTSIVLFLNKKDVFFEKIKKAHLSICFPDYDGPNTYEDAGNYIKVQFLELNMRRDVKEIYSHMTCATDTQNVKFVFDAVTDIIIKENLKDCGLF

SEQ ID NO: 823875 - protein, 273 aa, Homo sapiens
MGQKLSGSLKSVEVREPALRPAKRELRGAEPGRPARLDQLLDMPAAGLAVQLRHAWNPEDRSLNVFVKDDDRLTFHRHPVAQSTDGIRGKVGHARGLHAWQINWPARQRGTHAVVGVATARAPLHSVGYTALVGSDAESWGWDLGRSRLYHDGKNQPGVAYPAFLGPDEAFALPDSLLVVLDMDEGTLSFIVDGQYLGVAFRGLKGKKLYPVVSAVWGHCEVTMRYINGLDPEPLPLMDLCRRSIRSALGRQRLQDISSLPLPQSLKNYLQYQ

SEQ ID NO: 823876 - protein, 394 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRNLFDSIKSEPFSIPEDDGNDLTHTFFNPDREGWLLKLGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRVPFYDLVSTRKKKIASKQ

SEQ ID NO: 823877 - protein, 118 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGER

SEQ ID NO: 823878 - protein, 394 aa, Homo sapiens; identical to SEQ ID NO: 823876

SEQ ID NO: 823879 - protein, 103 aa, Homo sapiens
SVWASLSLRRAHPASLSSHPCLATSPQFFCLELYNPSCRGQKIKACKTDGDGRVVEGKHESYRISATSAEERDQWIESIRASITRVPFYDLVSTRKKKIASKQ

SEQ ID NO: 823880 - protein, 394 aa, Homo sapiens; identical to SEQ ID NO: 823876

SEQ ID NO: 823881 - protein, 157 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRFREGASDLGFGG

SEQ ID NO: 823882 - protein, 94 aa, Homo sapiens
AAPMKEGSKLPRTDCANTRMPGSRILAMEAPSSLPPPRPASMQQLLTASVYPLQGIQYFIEHKLLTPDVQDIARFLYKGEGLNKTAIGTYLGER

SEQ ID NO: 823883 - protein, 385 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRVTWECSQGEAGKGHFKKKKWPERRRVLIGKGEVSSVAENLFDSIKSEPFSIPEDDGNDLTHTFFNPDREGWLLKLGERPTDTRRRTHTHARAGTHRCMHTPGRTGPQLTRGSHASWGMELDSPRSPGPQCSRLPAPSIHLSREGREPVVGAEL

SEQ ID NO: 823884 - protein, 394 aa, Homo sapiens; identical to SEQ ID NO: 823876

SEQ ID NO: 823885 - protein, 417 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTGDPPASTSHSAEITGVSHHAKPKLLNPYINRLDTCYVLSFSIIMLNTSLHNPNVRDRPPFERFVSMNRGINNGSDLPEDQLRVTWECSQRRSRERTFQKEEVARTEAVLIGKGEVSSVAENLFDSIKSEPFSIPEDDGNDLTHTFFNPDREGWLLKLGERPTDTRRRTHTHARAGTHRCMHTPGRTGPQLTRGSHASWGMELDSPRSPGPQCSRLPAPSIHLSREGREPVVGAEL

SEQ ID NO: 823886 - protein, 386 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRNLFDSIKSEPFSIPEDDGNDLTHTFFNPDREGWLLKLGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRGPTSPRGPTS

SEQ ID NO: 823887 - protein, 75 aa, Homo sapiens
TSLHNPNVRDRPPFERFVSMNRGINNGSDLPEDQLRVREAQPTQPGPGESRRDLSLDGWPGRGSSEIDSPQWGLC

SEQ ID NO: 823888 - protein, 148 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 823889 - protein, 148 aa, Homo sapiens; identical to SEQ ID NO: 823888

SEQ ID NO: 823890 - protein, 148 aa, Homo sapiens; identical to SEQ ID NO: 823888

SEQ ID NO: 823891 - protein, 148 aa, Homo sapiens; identical to SEQ ID NO: 823888

SEQ ID NO: 823892 - protein, 164 aa, Homo sapiens
DPPGLQKFGPKEKYNAMFKRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 823893 - protein, 148 aa, Homo sapiens; identical to SEQ ID NO: 823888

SEQ ID NO: 823894 - protein, 148 aa, Homo sapiens; identical to SEQ ID NO: 823888

SEQ ID NO: 823895 - protein, 148 aa, Homo sapiens; identical to SEQ ID NO: 823888

SEQ ID NO: 823896 - protein, 148 aa, Homo sapiens; identical to SEQ ID NO: 823888

SEQ ID NO: 823897 - protein, 148 aa, Homo sapiens; identical to SEQ ID NO: 823888

SEQ ID NO: 823898 - protein, 148 aa, Homo sapiens; identical to SEQ ID NO: 823888

SEQ ID NO: 823899 - protein, 148 aa, Homo sapiens; identical to SEQ ID NO: 823888

SEQ ID NO: 823900 - protein, 148 aa, Homo sapiens; identical to SEQ ID NO: 823888

SEQ ID NO: 823901 - protein, 159 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIAGKKLVKIAVFFFFSFSFLKAWLHCN

SEQ ID NO: 823902 - protein, 159 aa, Homo sapiens; identical to SEQ ID NO: 823901

SEQ ID NO: 823903 - protein, 68 aa, Homo sapiens
LPRRPRFPRTASLVSAANITDLPALGHRTVAKRCPSIPNLTHPRLSLGEGGRDSQREGSAGVVCFGCA

SEQ ID NO: 823904 - protein, 135 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDNNIIFLSDQTKEKE

SEQ ID NO: 823905 - protein, 148 aa, Homo sapiens; identical to SEQ ID NO: 823888

SEQ ID NO: 823906 - protein, 148 aa, Homo sapiens; identical to SEQ ID NO: 823888

SEQ ID NO: 823907 - protein, 148 aa, Homo sapiens; identical to SEQ ID NO: 823888

SEQ ID NO: 823908 - protein, 116 aa, Homo sapiens
MFRRPVLQVLRQFVRHESETTTSLVLERSLNRVHFVGSAAHEVAAHKWKKSSRQGTANKFILHATFSQQDVALQIAVFRRNLRLQPHTGERLLRLIAISNISLNPEETNGTSWAAG

SEQ ID NO: 823909 - protein, 148 aa, Homo sapiens; identical to SEQ ID NO: 823888

SEQ ID NO: 823910 - protein, 148 aa, Homo sapiens; identical to SEQ ID NO: 823888

SEQ ID NO: 823911 - protein, 148 aa, Homo sapiens; identical to SEQ ID NO: 823888

SEQ ID NO: 823912 - protein, 159 aa, Homo sapiens; identical to SEQ ID NO: 823901

SEQ ID NO: 823913 - protein, 148 aa, Homo sapiens; identical to SEQ ID NO: 823888

SEQ ID NO: 823914 - protein, 155 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADEYYYFLWTPDDKEERGVRGK

SEQ ID NO: 823915 - protein, 68 aa, Homo sapiens; identical to SEQ ID NO: 823903

SEQ ID NO: 823916 - protein, 4367 aa, Homo sapiens
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTPLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLARTMRTERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLK

SEQ ID NO: 823917 - protein, 4367 aa, Homo sapiens; identical to SEQ ID NO: 823916

SEQ ID NO: 823918 - protein, 372 aa, Homo sapiens
MLDGLGVVAISIFGIQLKTEGSLRTAVPGIPTQSAFNKCLQRYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 823919 - protein, 372 aa, Homo sapiens; identical to SEQ ID NO: 823918

SEQ ID NO: 823920 - protein, 397 aa, Homo sapiens
GSLRGAMLRPGGAEEAAQLPLRRASAPVPVPSPAAPDGSRASARLGLACLLLLLLLTLPARVDTSWWYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 823921 - protein, 372 aa, Homo sapiens; identical to SEQ ID NO: 823918

SEQ ID NO: 823922 - protein, 181 aa, Homo sapiens
MCHWKPSLFLHFIQQKPEKQYCFHFKDMINIINIIMMMMMMKTKDFSRDLSFQNISGQYLIVFFFLNKSTSTFEKTHRAGQETQQKRGPPNKYPPRGGPTSNATTRFVANRGAPIGRAQISARPGARQHSRGGQTGTRRSWQETQLARAIGTTTRIKRDNTLAMWYNSMRGNLTGITKHTR

SEQ ID NO: 823923 - protein, 1837 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823924 - protein, 1564 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823925 - protein, 915 aa, Homo sapiens
MVLYKACILEARDVHSSEAARQREVLGFLHFVDLLHLNDKVLIGIVSCGPVESEAIPANLRHGYISQLWEILCDDLYSKGSSAVAPDLAVQVDCVRSARPEAWDFHGTQAARNREIVSLFHQVSLLDLNSKLVIGSIWRGPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823926 - protein, 1796 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTISHRLPAGL

SEQ ID NO: 823927 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823928 - protein, 288 aa, Homo sapiens
RVEHAMTRYKLKVERVQMGQQVTPWPTTMADPSPPLTRTQKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823929 - protein, 215 aa, Homo sapiens
MDRMEPDALSTVPHSFLSQRCPLSCNSLSTPRFIDMFIGFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823930 - protein, 110 aa, Homo sapiens
CPGGKFQLRFLRSIFLSLPGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823931 - protein, 2201 aa, Homo sapiens; identical to SEQ ID NO: 823927

SEQ ID NO: 823932 - protein, 2201 aa, Homo sapiens; identical to SEQ ID NO: 823927

SEQ ID NO: 823933 - protein, 1742 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANMFLFCCLIQQKSPSDNIAIVFYFS

SEQ ID NO: 823934 - protein, 1800 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPG

SEQ ID NO: 823935 - protein, 1639 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTGTVNKQERTEKSHDSGVFFSQG

SEQ ID NO: 823936 - protein, 1292 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTGILDEFTNSLPPLCLCSGGIKALSCFKLGSAPTTLGKYQ

SEQ ID NO: 823937 - protein, 1083 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTGESALSFLQTLG

SEQ ID NO: 823938 - protein, 113 aa, Homo sapiens
PESQRAIAFLSNSATLCPYAEEVPDMGNLTVTEVSWDALRLNWTTPDGTYDQFTIQVQEADQVEEAHNLTVPGSLRSMEIPGLRAGTPYTVTLHGEVRGHSTRPLAVEVVTGI

SEQ ID NO: 823939 - protein, 2201 aa, Homo sapiens; identical to SEQ ID NO: 823927

SEQ ID NO: 823940 - protein, 2110 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823941 - protein, 1655 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823942 - protein, 1100 aa, Homo sapiens
MTLLSCWCFNRDSTSRGCSEQSLALGLQWPIDVALGLPFPGSQKQNFLRNSLTDPISVIDSEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823943 - protein, 598 aa, Homo sapiens
MLSFLLLPPFSLPLEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823944 - protein, 2201 aa, Homo sapiens; identical to SEQ ID NO: 823927

SEQ ID NO: 823945 - protein, 317 aa, Homo sapiens
MDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 823946 - protein, 2201 aa, Homo sapiens; identical to SEQ ID NO: 823927

SEQ ID NO: 823947 - protein, 2201 aa, Homo sapiens; identical to SEQ ID NO: 823927

SEQ ID NO: 823948 - protein, 2201 aa, Homo sapiens; identical to SEQ ID NO: 823927

SEQ ID NO: 823949 - protein, 171 aa, Homo sapiens
DEPKSIEAGVKSVLDHPLPHKAKTHLSCKKLQLTPNDYESGFNISEHTIVYAVSINYKIQALNGPLRSNMIQTIFTTIGLLYPFPKDCSQAMLNGDTTSGLYTIYLNGDKAQALEVFCDMTRNKAQSEERILPKHQYNQPNHRSTPGHLVRVKADHGSLGPTATAWASPPL

SEQ ID NO: 823950 - protein, 1951 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGENFNQGKIFK

SEQ ID NO: 823951 - protein, 1673 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTGISNQVSHLFLFLVPFCVICLPDRHDFNIFVHIPYLIHKCSLLFHLLPTLPLVICT

SEQ ID NO: 823952 - protein, 1253 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPSTSVLPSTSVLPSTSVLPSTSVLPSTSVLP

SEQ ID NO: 823953 - protein, 1045 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWGDCNEAVADQIRPTDVYRT

SEQ ID NO: 823954 - protein, 1918 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 823955 - protein, 71 aa, Homo sapiens
LYSTGEVYSTGRLYSSGRLYSSRQGATPGGTHMAASPEQETGYGQRCLMITSASTSINAFHVFTPDKPTIL

SEQ ID NO: 823956 - protein, 1918 aa, Homo sapiens; identical to SEQ ID NO: 823954

SEQ ID NO: 823957 - protein, 2157 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVLQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGKKLWRNLPVASKFTSGARLSKDRYKRSFFGRLEENTMKSYESTHILRTLGEIHSLSPGAVAHAYNPNTLGGQGRWITRGHKFAISLANMVKSLSTKNTKISWVQWWVPVILATREAGAQESLEPGRWRLQSAEIAPLHSSLGDRVRLSQRKKKKKKEIHSLSPAGFETPTVTNTVLMFWRPPRTLQGPAVADAGSGKIQKWIPRGPVALWVLCLSSEEPFSSFLTGGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 823958 - protein, 1022 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVLQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGKKLWRNLPVASKFTSGARLSKDR

SEQ ID NO: 823959 - protein, 1200 aa, Homo sapiens
RPGFLSGGRPGFMRTKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 823960 - protein, 1810 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVLQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKL

SEQ ID NO: 823961 - protein, 908 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVCRPSATRKRK

SEQ ID NO: 823962 - protein, 86 aa, Homo sapiens
RPAPPRVCGERKPKVRGAGRGHRPAWAEAPALAGGSERTRRSRVSGPATAPAPDSSLPRREPRRPRRPATASALFQITESNVKEFR

SEQ ID NO: 823963 - protein, 153 aa, Homo sapiens
EVSLALARSTNIAIFVVAMRLDHCGTGTAAGQEQATGEWQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQNHKYRGAS

SEQ ID NO: 823964 - protein, 1930 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVLQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 823965 - protein, 1880 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGGQDPGVHHAWCPTGTVPAEVHLTPALGKSHEWTSAAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 823966 - protein, 1930 aa, Homo sapiens; identical to SEQ ID NO: 823964

SEQ ID NO: 823967 - protein, 1070 aa, Homo sapiens
EVSLALARSTNIAIFVVAMRLDHCGTGTAAGQEQATGEWQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 823968 - protein, 1218 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVLQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSHTVD

SEQ ID NO: 823969 - protein, 1012 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQPDSTLPGIDVLQTQRNQKKKMKKRVKDELRKLNTMTAAEANEIEDVWHLDLSSRWQLYRLWLQLYQADTRRKILSYERQYRTSAERMAELRLQEDLHILKDAQVVGMTTTGAAKYRQNHKYRGA

SEQ ID NO: 823970 - protein, 103 aa, Homo sapiens
QLSRDFQGSERGGRPRGKLEARVGNMSESELGRKWDRCLADAVVKIGTGFGLGIVFSLTFFKRRMWPLAFGSGMGLGMAYSNCQHDFQAPYLLHGKYVKEQEQ

SEQ ID NO: 823971 - protein, 103 aa, Homo sapiens; identical to SEQ ID NO: 823970

SEQ ID NO: 823972 - protein, 114 aa, Homo sapiens
MSTINTHSSARAEFGTSGTMERGGRPRGKLEARVGNMSESELGRKWDRCLADAVVKIGTGFGLGIVFSLTFFKRRMWPLAFGSGMGLGMAYSNCQHDFQAPYLLHGKYVKEQEQ

SEQ ID NO: 823973 - protein, 110 aa, Homo sapiens
QQVSVQVMKGLHYIDRPLQYQGLFTTANFLAPQDCNVNNKHTQFSSAEFGTSGTMERGGRPRGKLEARVGNMSESELGRKWDRCLADAVVKIVETGFHRVSQDGLDLLTS

SEQ ID NO: 823974 - protein, 114 aa, Homo sapiens; identical to SEQ ID NO: 823972

SEQ ID NO: 823975 - protein, 133 aa, Homo sapiens
QQVSVQVMKGLHYIDRPLQYQGLFTTANFLAPQDCNVNNKHTQFSSAEFGTSGTMERGGRPRGKLEARVGNMSESELGRKWDRCLADAVVKIGRMWPLAFGSGMGLGMAYSNCQHDFQAPYLLHGKYVKEQEQ

SEQ ID NO: 823976 - protein, 95 aa, Homo sapiens
QQVSVQVMKGLHYIDRPLQYQGLFTTANFLAPQDCNVNNKHTQFSSAEFGTSGTMERGGRPRGKLEARVGNMSESELGRKWDRCLADAVVKIESW

SEQ ID NO: 823977 - protein, 124 aa, Homo sapiens
QQVSVQVMKGLHYIDRPLQYQGLFTTANFLAPQDCNVNNKHTQFSSAEFGTSGTMERGGRPRGKLEARVGNMSESELGRKWDRCLADAVVKIEMGFHHVAQAGLELRVQTIHLPWPPNVPGLQA

SEQ ID NO: 823978 - protein, 140 aa, Homo sapiens
MSTINTHSSARAEFGTSGTMERGGRPRGKLEARVGNMSESELGRKWDRCLADAVVKIGTGFGLGIVFSLTFFKRRMWPLAFGSGMGLGMAYSNCQHDFQAPYLLHGKYVKDKRNHVYSSGILKCPGVSCHSSVTMLSVML

SEQ ID NO: 823979 - protein, 124 aa, Homo sapiens; identical to SEQ ID NO: 823977

SEQ ID NO: 823980 - protein, 70 aa, Homo sapiens
RGKLEARVGNMSESELGRKWDRCLADAVVKIGKGLFAPAGPAGAELLAPGCAAQEEGREAPREVRPLGLF

SEQ ID NO: 823981 - protein, 114 aa, Homo sapiens; identical to SEQ ID NO: 823972

SEQ ID NO: 823982 - protein, 74 aa, Homo sapiens
HLCTKARVRSSQGPCKKRRSCVALKPAAGLFHHSLAPRFPGIRADCGENRKEQTEKLQVFCLKHFHCSKLSCQG

SEQ ID NO: 823983 - protein, 95 aa, Homo sapiens; identical to SEQ ID NO: 823976

SEQ ID NO: 823984 - protein, 114 aa, Homo sapiens; identical to SEQ ID NO: 823972

SEQ ID NO: 823985 - protein, 66 aa, Homo sapiens
ADPQNGRAAIRLKKCLDRIVSLPPERRMWPLAFGSGMGLGMAYSNCQHDFQAPYLLHGKYVKEQEQ

SEQ ID NO: 823986 - protein, 110 aa, Homo sapiens; identical to SEQ ID NO: 823973

SEQ ID NO: 823987 - protein, 140 aa, Homo sapiens; identical to SEQ ID NO: 823978

SEQ ID NO: 823988 - protein, 134 aa, Homo sapiens
MSTINTHSSARAEFGTSGTMERGGRPRGKLEARVGNMSESELGRKWDRCLADAVVKIEMGFHHVAQAGLELRVQTIHLPWPPNVPGLQAVNQYFISDTRYVGVFPHTSTSSPTGYPVTHFNSDTVCLETTTRLP

SEQ ID NO: 823989 - protein, 1506 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYIHIIFSERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 823990 - protein, 1533 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYIHIIFSERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKVTAILPKVPLGSENYASSPVISIHFLQDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 823991 - protein, 1081 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYIHIIFSERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMG

SEQ ID NO: 823992 - protein, 1506 aa, Homo sapiens; identical to SEQ ID NO: 823989

SEQ ID NO: 823993 - protein, 821 aa, Homo sapiens
ENVKPSGRQIGKLSHSNPTILFDYILSQIQKYDNLITPVVDSLKYLTSLNYDVLAYCIIEALANPEKERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREKREGAIQRKRYSKGNEIKGKC

SEQ ID NO: 823994 - protein, 1506 aa, Homo sapiens; identical to SEQ ID NO: 823989

SEQ ID NO: 823995 - protein, 1506 aa, Homo sapiens; identical to SEQ ID NO: 823989

SEQ ID NO: 823996 - protein, 1357 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYIHIIFSERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKKKNTQKKKKKKGGGAKKKLPPGGGTIEHVLKKGGPKRERGDKTHSGRGADQNNAGVGETAVRRDTWARTQTTGGETTREHHQDNYSPRGKTRRGIGGTTHERADDRNGYRDECTLSRGQKRSWTTEITNTATSDKPQGIHEREKSTTDEEPHERDNEPTE

SEQ ID NO: 823997 - protein, 1081 aa, Homo sapiens; identical to SEQ ID NO: 823991

SEQ ID NO: 823998 - protein, 238 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGKTFICIVCVVKITSYFSYWRISIKTK

SEQ ID NO: 823999 - protein, 1292 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYIHIIFSERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREKREGAIQRKRYSKGNEIKGKC

SEQ ID NO: 824000 - protein, 1314 aa, Homo sapiens
HIRASATSERKMAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYIHIIFSERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGVEVYLLPSGDYGRLCDHVSTGCYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREKREGAIQRKRYSKGNEIKGKC

SEQ ID NO: 824001 - protein, 548 aa, Homo sapiens
MLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 824002 - protein, 339 aa, Homo sapiens
MEIVALTATKLLKKMTKKKGKRKKKRKKKRLQLLLQRPGYLVKMVKKNQRKSGQIKMKKQERPRKERRSLTKRKKNSRRKKKLKMRNLRPLSPTQNQNQLKKGKREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 824003 - protein, 377 aa, Homo sapiens
ATVATSSRGAGRLSGKRRARGRRAGWGSAAQCQRQRQTRAPRSPARRLPWDSRARTPALPVRCPSMELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSQPRAQPDQHSYRCHSHTPVALERPSGVATKQRRGRCHPPPCLQEPHHI

SEQ ID NO: 824004 - protein, 357 aa, Homo sapiens
ATVATSSRGAGRLSGKRRARGRRAGWGSAAQCQRQRQTRAPRSPARRLPWDSRARTPALPVRCPSMELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSPAPKAPRGSSSQGPSQTSTPTDVTAIHL

SEQ ID NO: 824005 - protein, 357 aa, Homo sapiens; identical to SEQ ID NO: 824004

SEQ ID NO: 824006 - protein, 290 aa, Homo sapiens
MTTTGSREHGPRGMLRGVTVSLLSCVFFWIDVCEVPTASSTSFAYSRRSSRYCGMNAGLTEWLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSPAPKAPRGSSSQGPSQTSTPTDVTAIHL

SEQ ID NO: 824007 - protein, 242 aa, Homo sapiens
MPLCLLRPLFPTSCPALDRRRGADFVNTSPLQGGDWLCSDAGRGGEVQSSPRGWWLRPPPLPKGRLRRRRDRAPATPVGAPGRSPDEEDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSPAPKAPRGSSSQGPSQTSTPTDVTAIHL

SEQ ID NO: 824008 - protein, 285 aa, Homo sapiens
ATVATSSRGAGRLSGKRRARGRRAGWGSAAQCQRQRQTRAPRSPARRLPWDSRARTPALPVRCPSMELLCCEGTRHAPRAGPDPRLLGDQRVLQSLLRLEERYVPRASYFQCVQREIKPHMRKMLAYWMLEDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSPAPKAPRGSSSQGPSQTSTPTDVTAIHL

SEQ ID NO: 824009 - protein, 231 aa, Homo sapiens
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSQPRAQPDQHSYRCHSHTPVALERPSGVATKQRRGRCHPPPCLQEPHHI

SEQ ID NO: 824010 - protein, 357 aa, Homo sapiens; identical to SEQ ID NO: 824004

SEQ ID NO: 824011 - protein, 274 aa, Homo sapiens
ATVATSSRGAGRLSGKRRARGRRAGWGSAAQCQRQRQTRAPRSPARRLPWDSRARTPALPVRCPSMELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYSFAMFPPCMNTPGGSC

SEQ ID NO: 824012 - protein, 169 aa, Homo sapiens
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVGECWVAGQQPLHS

SEQ ID NO: 824013 - protein, 357 aa, Homo sapiens; identical to SEQ ID NO: 824004

SEQ ID NO: 824014 - protein, 211 aa, Homo sapiens [sequence omitted]

SEQ ID NO: 824015 - protein, 357 aa, Homo sapiens; identical to SEQ ID NO: 824004

SEQ ID NO: 824016 - protein, 341 aa, Homo sapiens
ATVATSSRGAGRLSGKRRARGRRAGWGSAAQCQRQRQTRAPRSPARRLPWDSRARTPALPVRCPSMELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATGLPAGLSGADRSCTQGEPQGSRSDQLQPSAQSPPGLQQPRAQPDQHSYRCHSHTPVALERPSGVATKQRRGRCHPPPCLQEPHHI

SEQ ID NO: 824017 - protein, 187 aa, Homo sapiens
PHVCNSEMGPGLGTHDEWTGVELPAFSRDLYWQDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREAAQTSSSPAPKAPRGSSSQGPSQTSTPTDVTAIHL

SEQ ID NO: 824018 - protein, 112 aa, Homo sapiens
SARYEAWGVATDYTFAMYPPSMIATGSIGAAVQGLGACSMSGDELTELLAGITGTEVDCLRACQEQIEAALRESLREAAQTSSSPAPKAPRGSSSQGPSQTSTPTDVTAIHL

SEQ ID NO: 824019 - protein, 352 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 824020 - protein, 111 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPLFAHYDTGLLTLWTVTRN

SEQ ID NO: 824021 - protein, 352 aa, Homo sapiens; identical to SEQ ID NO: 824019

SEQ ID NO: 824022 - protein, 352 aa, Homo sapiens; identical to SEQ ID NO: 824019

SEQ ID NO: 824023 - protein, 352 aa, Homo sapiens; identical to SEQ ID NO: 824019

SEQ ID NO: 824024 - protein, 352 aa, Homo sapiens; identical to SEQ ID NO: 824019

SEQ ID NO: 824025 - protein, 352 aa, Homo sapiens; identical to SEQ ID NO: 824019

SEQ ID NO: 824026 - protein, 352 aa, Homo sapiens; identical to SEQ ID NO: 824019

SEQ ID NO: 824027 - protein, 352 aa, Homo sapiens; identical to SEQ ID NO: 824019

SEQ ID NO: 824028 - protein, 352 aa, Homo sapiens; identical to SEQ ID NO: 824019

SEQ ID NO: 824029 - protein, 352 aa, Homo sapiens; identical to SEQ ID NO: 824019

SEQ ID NO: 824030 - protein, 238 aa, Homo sapiens [sequence omitted]

SEQ ID NO: 824031 - protein, 331 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCPRTFNSSRTGSFGPPLCLPAPGGLWLSKPYLTYPSVGVGL

SEQ ID NO: 824032 - protein, 143 aa, Homo sapiens [sequence omitted]

SEQ ID NO: 824033 - protein, 283 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQVRALLQAPVVTGSPFPLTLFLRGNPHCG

SEQ ID NO: 824034 - protein, 389 aa, Homo sapiens
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 824035 - protein, 352 aa, Homo sapiens; identical to SEQ ID NO: 824019

SEQ ID NO: 824036 - protein, 352 aa, Homo sapiens; identical to SEQ ID NO: 824019

SEQ ID NO: 824037 - protein, 265 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVRTWPGWVNATRAAWPLLSSLDGRRSWRTLSGGSTPA

SEQ ID NO: 824038 - protein, 352 aa, Homo sapiens; identical to SEQ ID NO: 824019

SEQ ID NO: 824039 - protein, 352 aa, Homo sapiens; identical to SEQ ID NO: 824019

SEQ ID NO: 824040 - protein, 352 aa, Homo sapiens; identical to SEQ ID NO: 824019

SEQ ID NO: 824041 - protein, 375 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKFLICDLGIAVVSPRRGCCDGSLGPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 824042 - protein, 352 aa, Homo sapiens
DPSHPADPGRLCRRLRPQPSPSGAAGAAALLPSPRLGPPAPAAPGVRPERPSPSGTPDSPHPPPPRLSSIRPPPAVPPLPAIELPYFHKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 824043 - protein, 283 aa, Homo sapiens; identical to SEQ ID NO: 824033

SEQ ID NO: 824044 - protein, 261 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVLGSSWRHPFNLAGLTGKVAVDLLGDMARGLDG

SEQ ID NO: 824045 - protein, 199 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKGFPQERKAEQLRKKLKKPPGNIGKETEKEGEKRTWEGE

SEQ ID NO: 824046 - protein, 485 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKKKISKRKVRRKLPLMWKKKEPGKASETKQGTVKIAAQAAAKKDEKKEDSKKTKKPAEVEQPKGKKQEKKEKHVEPAKSPKKEHSVPSDKQVKAKTERAKEEIGAVSSKKAVPGKKEEKTTRQWSQKLDNETSATTSPILEDKELIRARPESPG

SEQ ID NO: 824047 - protein, 167 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKEVGHSS

SEQ ID NO: 824048 - protein, 312 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKGFPGPGIRNSSYYCQYIKGQINAWNDLRTSLLPIPYLSCGKMCSNFNN

SEQ ID NO: 824049 - protein, 295 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKDQYAFCRYMIDIFVHGDLKPGIPSNSCTCLF

SEQ ID NO: 824050 - protein, 185 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKDWSANSSTIRTLKLTQLKPIYICT

SEQ ID NO: 824051 - protein, 486 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKKKISKRKVRRKLPLMWKKKEPGKASETKQGTVKIAAQAAAKKDEKKEDSKKTKKPAEVEQPKGKKQEKKEKHVEPAKSPKKEHSVPSDKQVKAKTERAKEEIGAVSSKKSCTWKRRKRKQPRQWSQKLDNETSATTSPILEDKELIRARPESPG

SEQ ID NO: 824052 - protein, 486 aa, Homo sapiens; identical to SEQ ID NO: 824051

SEQ ID NO: 824053 - protein, 351 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKKGNRKGEKKSSETKKKKRDYQEGEERWWEKERKLNKRRN

SEQ ID NO: 824054 - protein, 416 aa, Homo sapiens
MTEITAEASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKKKISKRKVRRKLPLMWKKKEPGKASETKQGTVKIAAQAAAKKDEKKEDSKKTKKPAEVEQPKGKKQEKKEKHVEPAKSPKKEHSVPSDKQVKAKTERAKEEIGAVSSKKSCTWKRRKRKQPRQWSQKLDNETSATTSPILEDKELIRARPESPG

SEQ ID NO: 824055 - protein, 188 aa, Homo sapiens
RKARAGIPGVVVSCLDVLEQSDHTAAWRNPGTMGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 824056 - protein, 171 aa, Homo sapiens
SEATPPEAAVQNPGTMGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 824057 - protein, 171 aa, Homo sapiens
MGEPEGSWSGKNPGTMGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 824058 - protein, 171 aa, Homo sapiens; identical to SEQ ID NO: 824056

SEQ ID NO: 824059 - protein, 181 aa, Homo sapiens
MKEVGSVPTLPRAGLETVDKWLDSTGPGLSLVHRGHWARTAFLPPEAPHHLRAPPQSLSTKISVFKVQVDSEAAARELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 824060 - protein, 131 aa, Homo sapiens
MGLGESGAGSSKETRRAGGLGERQGERGGGLGETRSKSQKFTLETVASGRNRSVSGQSTRAWCETKPQTHLPCLTCLRHQDPVSVKWERFPCPPRRACDEDVAHFFSAPLLKPLGEHTDRQAEGLPPHGSV

SEQ ID NO: 824061 - protein, 200 aa, Homo sapiens
MKEVGSVPTLPRAGLETVDKWLDSTGPGLSLVHRGHWARTAFLPPEAPHHLRAPPQSLSTKISVFKVQVDSEAQPGRDQIMHSRGHPPGSPIHPGGSWAVCRCPAPPPCHRVGMAPCPDGLPPLPTSARRELQEESGLTVDALHKVGQIVFEFVGEPELMDVHVFCTDSIQGTPVESDGESHRACSPSPLCGSHLLAGRK

SEQ ID NO: 824062 - protein, 171 aa, Homo sapiens; identical to SEQ ID NO: 824057

SEQ ID NO: 824063 - protein, 77 aa, Homo sapiens
RGSPHHNIARQHSGTPVESDEMRPCWFQLDQIPFKDMWPDDSYWFPLLLQKKKFHGYFKFQGQDTILDYTLREVDTV

SEQ ID NO: 824064 - protein, 156 aa, Homo sapiens
MGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 824065 - protein, 156 aa, Homo sapiens; identical to SEQ ID NO: 824064

SEQ ID NO: 824066 - protein, 165 aa, Homo sapiens
MGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDVPPLPPLVTEMRPCWFQLDQIPFKDMWPDDSYWFPLLLQKKKFHGYFKFQGQDTILDYTLREVDTV

SEQ ID NO: 824067 - protein, 206 aa, Homo sapiens
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRHFLQITLCVCELYGCWMTFLPEWLTRSPNLNTSNWLYCWLYLFFFNGVWVLIPGLLLWQSWLELKKMHQKETSSVKKFQ

SEQ ID NO: 824068 - protein, 246 aa, Homo sapiens
MHAGTGWGFWILGLLCVVKPEALALSGSWVACCDWLCSVCLSVLPAVSLCCAVCCCPCVLCCSVCPAVCSAVLCVTCCVALIWLCYALLCALLLLECEGPFVYLSLVGNVANSDGLIASLWKEYGKADARWVYFDPTIVSVEILTVALDGSLALFLIYAIVKEKYYRHFLQITLCVCELYGCWMTFLPEWLTRSPNLNTSNWLYCWLYLFFFNGVWVLIPGLLLWQSWLELKKMHQKETSSVKKFQ

SEQ ID NO: 824069 - protein, 121 aa, Homo sapiens
GPDPAGEPRPSPDRLGQSAPLLLGHPAPPLPGQPRPVVSLPAFLCRMVLGRWRRKPEAWALSGSWGPRLAVRCCCAPRCWRRAAPWACAWAAGRGRRTAGRSSGSATTRWCTSRWERIWQS

SEQ ID NO: 824070 - protein, 164 aa, Homo sapiens
PPTLPRARREHALPKLVLIGCMHSGVGVASMGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRDRVAWGE

SEQ ID NO: 824071 - protein, 206 aa, Homo sapiens; identical to SEQ ID NO: 824067

SEQ ID NO: 824072 - protein, 206 aa, Homo sapiens; identical to SEQ ID NO: 824067

SEQ ID NO: 824073 - protein, 152 aa, Homo sapiens
MGAEWELGAEAGGSLLLCAALLAAGCALGLRLGRGQGAADRGALIWLCYDALVHFALEGPFVYLSLVGNVANSDGLIASLCESRSVPQAGAQWHHLGSLQAPPPRFTPFSCLSLPSSWDYRRPPPRLANFFVFLVETGFHHVSQDGLDLLTS

SEQ ID NO: 824074 - protein, 102 aa, Homo sapiens
MGAEWELGAEAGGSLLLCAALLAAGCALGLRLGRGQGAADRGALIWLCYDALVHFALAFPADHPVRVRAVWLLDDLPPRVAHQKPQPQHQQLAVLLALPVFF

SEQ ID NO: 824075 - protein, 134 aa, Homo sapiens
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRDRVAWGE

SEQ ID NO: 824076 - protein, 123 aa, Homo sapiens
GPDPAGEPRPSPDRLGQSAPLLLGHPAPPLPGQPRPVVSLPAFLCRMVLGRWRRKPEAWALSGSWGPRLAVRCCCAPRCWRRAAPWACAWAAGRGRRTAGRSSGSATTRWCTSRWKALLSTCL

SEQ ID NO: 824077 - protein, 206 aa, Homo sapiens; identical to SEQ ID NO: 824067

SEQ ID NO: 824078 - protein, 551 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 824079 - protein, 190 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVENLAYLVPLGSFWLTYGG

SEQ ID NO: 824080 - protein, 728 aa, Homo sapiens
MCKKALFAGEQEFNQKGQIPCHHLTLQTPPSSHLSSPLLQQGQNQQQGLQSLGQQSGYSPTSRYTGKLANTLGNDVFNVFSIQLTDNLVSRSSSASIPTLSKIFLMSLALGEELPPEGSQQVGGDVAHRGGVCGGGGGEVSRVRPSCRIRHENQHPHFRDYLRAFWTKLPTRIREEEMAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 824081 - protein, 551 aa, Homo sapiens; identical to SEQ ID NO: 824078

SEQ ID NO: 824082 - protein, 571 aa, Homo sapiens
MFCEHHSFKCLFHCRIREEEMAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 824083 - protein, 519 aa, Homo sapiens
RILLPSGRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 824084 - protein, 417 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKP

SEQ ID NO: 824085 - protein, 241 aa, Homo sapiens [sequence omitted]

SEQ ID NO: 824086 - protein, 551 aa, Homo sapiens; identical to SEQ ID NO: 824078

SEQ ID NO: 824087 - protein, 630 aa, Homo sapiens
QTRACARGGRAAAGKAESKGKTKLRTSSPEAAGLRPAAAAAAAAAQVCFSGGLQNQHPHFRDYLRAFWTKLPTRIREEEMAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 824088 - protein, 551 aa, Homo sapiens; identical to SEQ ID NO: 824078

SEQ ID NO: 824089 - protein, 358 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRMD

SEQ ID NO: 824090 - protein, 115 aa, Homo sapiens
CAPVFLFPFSSRLPYPPSLYNLKISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 824091 - protein, 1185 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 824092 - protein, 199 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKPGGAR

SEQ ID NO: 824093 - protein, 707 aa, Homo sapiens
MSRIPSIMCAQEGIQLHFYKVRTLRSDRNCPEITVMERVVATTTSMRSTEKGLNCLSGRRMKLMLEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 824094 - protein, 961 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKSKSPK

SEQ ID NO: 824095 - protein, 1185 aa, Homo sapiens; identical to SEQ ID NO: 824091

SEQ ID NO: 824096 - protein, 1057 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKETERERERERERERES

SEQ ID NO: 824097 - protein, 199 aa, Homo sapiens; identical to SEQ ID NO: 824092

SEQ ID NO: 824098 - protein, 1185 aa, Homo sapiens; identical to SEQ ID NO: 824091

SEQ ID NO: 824099 - protein, 1173 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 824100 - protein, 973 aa, Homo sapiens
MSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 824101 - protein, 810 aa, Homo sapiens
PSLPDLLAPDLGHQGHKRMHNRVGAERLNPIPAFAPRRPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 824102 - protein, 1124 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQPDPAHP

SEQ ID NO: 824103 - protein, 837 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANLTCNNSKNKTLVTQNSGVE

SEQ ID NO: 824104 - protein, 112 aa, Homo sapiens
VKLKEAMGGLPEVCVACTAARGSPEISPIYGRGWGEGRVPGSGREGCQATFLTCSPYTEALPTGESSCQPGQWGVGPNEQWVTRYELRSAHLLGAPPPLHPQALPFKKFHLG

SEQ ID NO: 824105 - protein, 518 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGTPARAAGAGRRQRARSAAAARAHPGHQDRERYVPLAAPAPVPGRRPGQRQRRRGAQDREPRQQQQQPVQREQPPGQPAVGAAAQPGRCGFRAAAARALRPAAAPYQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 824106 - protein, 553 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 824107 - protein, 553 aa, Homo sapiens; identical to SEQ ID NO: 824106

SEQ ID NO: 824108 - protein, 279 aa, Homo sapiens
PGGEFGTRDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKDGTIKEGKWDNHKLSWRAQREDLSRGNQTGRQSQTGAQIGTLQNRIPNIPTLPLSKGHQRPLVLMAENTATRGEHPTRSYKPGERPDSTRREDVR

SEQ ID NO: 824109 - protein, 695 aa, Homo sapiens
PCPGARREQPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824110 - protein, 700 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824111 - protein, 644 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLLRHRG

SEQ ID NO: 824112 - protein, 697 aa, Homo sapiens
ASVMTTGRPHEPLWGPPGPLKPPTPQRAFSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824113 - protein, 579 aa, Homo sapiens
VAVLEDPRLDVNVVDRDEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824114 - protein, 742 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGACRGERRPCAGAHVRAQVPVPPALGLGMGAGPVTKTPLGLGCILLSPQAR

SEQ ID NO: 824115 - protein, 694 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGST

SEQ ID NO: 824116 - protein, 457 aa, Homo sapiens
MSWVRGSVYFIRGRQLAMEFNIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824117 - protein, 474 aa, Homo sapiens
MEISEIPCALCNQKGPWRQRLRSKPRPLTVLLSSPPSPFDAKNPFLAAVTTNRKLNQGTERHLMHLELDISDSKIRYQLPLSPPETLTLGLLTWGRASLPPLPSLTSPSRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824118 - protein, 168 aa, Homo sapiens
PCPGARREQPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVACSSCRACELLTTGSTL

SEQ ID NO: 824119 - protein, 220 aa, Homo sapiens
PCPGARREQPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVSHPETAMGSRWPAVPPWGLQIHVSERQPSRPP

SEQ ID NO: 824120 - protein, 700 aa, Homo sapiens; identical to SEQ ID NO: 824110

SEQ ID NO: 824121 - protein, 700 aa, Homo sapiens; identical to SEQ ID NO: 824110

SEQ ID NO: 824122 - protein, 732 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGLSEWGHWNRGQGGQGPACHSWPSPQHPLFLPRDARNMARDVQNTFYDIVAELGAMEHAQAVDYIKKLMTKGRYSLDVWS

SEQ ID NO: 824123 - protein, 605 aa, Homo sapiens
MKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824124 - protein, 785 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGCNQLSWLPPVVSWVCLAWPWHGRRPSDKDSSGPGVHPPQPPGQVRSTGPWQHSPGPAWGHRAPCLWRPLALGGCTEGLFLSAELGPAPPRDFQ

SEQ ID NO: 824125 - protein, 736 aa, Homo sapiens
QTRLVRGCVCIGRGPGCQRFMINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGWQHSPGPAWGHRAPCLWRPLALGGCTEGLFLSAELGPAPPRDFQ

SEQ ID NO: 824126 - protein, 440 aa, Homo sapiens
MEISEIPCALCNQKGPWRQRLRSKPRPLTVLLSSPPSPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824127 - protein, 380 aa, Homo sapiens
PGGEFGTRDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 824128 - protein, 78 aa, Homo sapiens
PCPGARREQPGCQRFMINMGDSHVDTSSTVSEAVAEEVSLFSMTDMILFSLIVGLLTYWFLFRKKKEEVPEFTKIQTL

SEQ ID NO: 824129 - protein, 171 aa, Homo sapiens
MSRLWYGKKGRRHQPINHKYTLITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVLSDGIICLSKGMIIVWGERELAW

SEQ ID NO: 824130 - protein, 571 aa, Homo sapiens
MTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 824131 - protein, 243 aa, Homo sapiens
MSRLWYGKKGRRHQPINHKYTLVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 824132 - protein, 383 aa, Homo sapiens
MTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEVVSVAEYHRRIDALNTEELRTLCRRLQVPPSVV

SEQ ID NO: 824133 - protein, 544 aa, Homo sapiens
MTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 824134 - protein, 216 aa, Homo sapiens
MSRLWYGKKGRRHQPINHKYTLITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 824135 - protein, 432 aa, Homo sapiens
MTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTSFWCVSI

SEQ ID NO: 824136 - protein, 416 aa, Homo sapiens
SFSHTRREERKAMADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 824137 - protein, 395 aa, Homo sapiens
SFSHTRREERKAMADKVLKEKRKLFIRSMGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 824138 - protein, 100 aa, Homo sapiens
SFSHTRREERKAMADKVLKEKRKLFIRSMGEDNVSWRHPTMGSVFIGRLIEHMQEYACSCDVEEIFRKVRFSFEQPDGRAQMPTTERVTLTRCFYLFPGH

SEQ ID NO: 824139 - protein, 395 aa, Homo sapiens; identical to SEQ ID NO: 824137

SEQ ID NO: 824140 - protein, 367 aa, Homo sapiens
MGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 824141 - protein, 342 aa, Homo sapiens
CRPSRRDCAAAGAAADADREEEGRRRAGELKSRQPLDRLPYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 824142 - protein, 323 aa, Homo sapiens
SFSHTRREERKAMADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 824143 - protein, 275 aa, Homo sapiens
SFSHTRREERKAMADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDNVSWRHPTMGSVFIGRLIEHMQEYACSCDVEEIFRKVRFSFEQPDGRAQMPTTERVTLTRCFYLFPGH

SEQ ID NO: 824144 - protein, 395 aa, Homo sapiens; identical to SEQ ID NO: 824137

SEQ ID NO: 824145 - protein, 375 aa, Homo sapiens
SFSHTRREERKAMADKVLKEKRKLFIRSMGEGTINGLLDELLQTRVLNKEEMEKVKRENATVMDKTRALIDSVIPKGAQACQICITYICEEDTMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 824146 - protein, 89 aa, Homo sapiens
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 824147 - protein, 89 aa, Homo sapiens; identical to SEQ ID NO: 824146

SEQ ID NO: 824148 - protein, 89 aa, Homo sapiens; identical to SEQ ID NO: 824146

SEQ ID NO: 824149 - protein, 106 aa, Homo sapiens
MAPEEIIMDRPFLFVVRHNPTGEPGTHHRSTSSHPFFLSGTSPDRCRHPSIPERALGREPITLPCFLSQEEATFYHPQTVPGPRSVTQAAATPDSSLICLDLSPST

SEQ ID NO: 824150 - protein, 89 aa, Homo sapiens
LHQPSFHCSRMQMSPALTCLVLGLALVFGEGSAVHHPPSYVAHLASDFGVRVFQQVAQASKDRNVVFSPYGVASVLAMLQLTTGRITQG

SEQ ID NO: 824151 - protein, 451 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824152 - protein, 451 aa, Homo sapiens; identical to SEQ ID NO: 824151

SEQ ID NO: 824153 - protein, 320 aa, Homo sapiens
RTRGRPRVDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824154 - protein, 451 aa, Homo sapiens; identical to SEQ ID NO: 824151

SEQ ID NO: 824155 - protein, 269 aa, Homo sapiens
SVGTQADSSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824156 - protein, 451 aa, Homo sapiens; identical to SEQ ID NO: 824151

SEQ ID NO: 824157 - protein, 316 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIACRPGSH

SEQ ID NO: 824158 - protein, 450 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVAWPSPSPETVCMGYFGV

SEQ ID NO: 824159 - protein, 451 aa, Homo sapiens; identical to SEQ ID NO: 824151

SEQ ID NO: 824160 - protein, 524 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGEPGTHHRSTSSHPFFLSGTSPDRCRHPSIPERALGREPITLPCFLSQEEATFYHPQTVPGPRSVTQAAATPDSSLICLDLSPST

SEQ ID NO: 824161 - protein, 432 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSAPLPQRYFCTMGSSRT

SEQ ID NO: 824162 - protein, 489 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTGESGSGEAPRVSPPSPFRITGPQTRKGPRSPLGTEQLCLCSAITHSPPVSQPGKRAWDHGTLFPRLMAPKFPDCEKAS

SEQ ID NO: 824163 - protein, 349 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPK

SEQ ID NO: 824164 - protein, 328 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYSKSKSPFPTAHSNCISFLGSPKEYPKCHPLREEDHRECSPLREERP

SEQ ID NO: 824165 - protein, 142 aa, Homo sapiens
GHSCVWLQGQERCQEDPHAPLQQLNSCSSAAAARAGRTANRKAPLRTSGRRKANSLQPLTSGLRQRTRLPRISSLHDPPLFLYFLFLGPAALGRPCPRGDCRRAGRMVRRHQQPHHPVTRTLTLSVPLHQDTYPFPTSCLLT

SEQ ID NO: 824166 - protein, 160 aa, Homo sapiens [sequence omitted]

SEQ ID NO: 824167 - protein, 439 aa, Homo sapiens
PAAFLLLLPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824168 - protein, 451 aa, Homo sapiens; identical to SEQ ID NO: 824151

SEQ ID NO: 824169 - protein, 321 aa, Homo sapiens
YIYDLSEYLNKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824170 - protein, 257 aa, Homo sapiens
KTTTTTTTKSSNFLIFLIIDFPIGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824171 - protein, 235 aa, Homo sapiens
KTTTTTTTKSSNFLIFLIIDFPIGMISNLLGKGAVDQLTRLVLVNALYFNGQWKTPFPDSSTHRRLFHKSDGSTVSVPMMAQTNKFNYTEFTTPDGHYYDILELPYHGDTLSMFIAHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 824172 - protein, 100 aa, Homo sapiens
QKRREIEIKILNRGAVNRGYPKAKSEREPGFQKYVEKPGELGENPVLGCHQRELEPFPTNHLVVFTAEFTTPDGHYYDILELPYHGDTLSMFIACRPGSH

SEQ ID NO: 824173 - protein, 451 aa, Homo sapiens; identical to SEQ ID NO: 824151

SEQ ID NO: 824174 - protein, 457 aa, Homo sapiens
GAQLCLAAGPRALSRRPTRPPPAAEFLQLSSRRQSRTNRQSQGTSENFRMQMSPALTCLVLGLALVFGEGSAVHHPPSYVAHLASDFGVRVFQQVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMDPRGILDR

SEQ ID NO: 824175 - protein, 328 aa, Homo sapiens; identical to SEQ ID NO: 824164

SEQ ID NO: 824176 - protein, 137 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNFTFWLSLLCSGS

SEQ ID NO: 824177 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 824178 - protein, 153 aa, Homo sapiens
MAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 824179 - protein, 123 aa, Homo sapiens
KVIVIHREMFQRAQALRRRAEDYYRCKITPSARKPLCNRVSLLVFLAFGHSLPGQDMDTFFSLRLCAQALQREMAERKAAYKHHSPIPVGNCVAQKHLHPHPVGPPSNILSVRGSVFVIANGP

SEQ ID NO: 824180 - protein, 615 aa, Homo sapiens
GCGSAISHSTRSTGMILLVEALHSGVNSGVGFRADSHPDVPGSVPSATQTQSTPTSRQACDLRVSAPGRYLSEEPEPYLAVYLHSEPRPNERNCSASRRIRPESLQGADHRPYTFFISPGTRDPVGSYRLNLSSHFRWSALEVSVGLYTSLCQYFSEEDVVWRTEGLLPLEETSPRQAVCLTRHLTAFGTSLFVPPSHIRFVFPEPTADVNYIVMLTCAVCLVTYMVMAAILHKLDQLDASRGCAIPFCGQRGRFKYEILVKTGWGRGSGTTAHVGIMLYGVDSRSGHRHLDGDRAFHRNSLDIFQIATPHSLGSVWKIRVWHDNKGLYGPCQALPLCPCIGAPCEPDLPPAPLQGSALPGSCSTSSSGTCRRHAAPSSWSMTGFRWRRRPTGAWWRRRCWPRVRPRSVFPLRGRLGRVVLPRGLLQCGPPCLLGHAALLRFRRLLVAELQRGFFDKHIWLSIWDRPPRSCFTRIQRATCCVLLICLFLGANAVWYGAVGDSAYSTGRVSRLNPLSVDTVAVGLVSSVVVYPVYLAILFLFRMSRSKVAGSPSPTPAGQQVLDVDSCLDSSVLDSSFLTFSGLHAEVRALLGVLPPWRSLDSRPCAPLSRPLLDR

SEQ ID NO: 824181 - protein, 544 aa, Homo sapiens
GCGSAISHSTRSTGMILLVEALHSGVNSGVGFRADSHPDVPGSVPSATQTQSTPTSRQACDLRVSAPGRYLSEEPEPYLAVYLHSEPRPNERNCSASRRIRPESLQGADHRPYTFFISPGTRDPVGSYRLNLSSHFRWSALEVSVGLYTSLCQYFSEEDVVWRTEGLLPLEETSPRQAVCLTRHLTAFGTSLFVPPSHIRFVFPEPTADVNYIVMLTCAVCLVTYMVMAAILHKLDQLDASRGCAIPFCGQRGRFKYEILVKTGWGRGSGTTAHVGIMLYGVDSRSGHRHLDGDRAFHRNSLDIFQIATPHSLGSVWKIRVWHDNKGLYGPCQALPLCPCIGAPCEPDLPPAPLQGSALPGSCSTSSSGTCRRHAAPSSWSMTGFRWRRRPTGAWWRRRCWPRVRPRSVFPLRGRLGRVVLPRGLLQCGPPCLLGHAALLRFRRLLVAELQRGFFDKHIWLSIWDRPPRSCFTRIQRATCCVLLICLFLGANAVWYGAVGDSAYRWLGARAPHLPGSRCWTSTAAWTHPCWTAPSSRSQASTLR

SEQ ID NO: 824182 - protein, 130 aa, Homo sapiens
SPVPHGVGAQEETDEENAAGGPLVSSVVVYPVYLAILFLFRMSRSKVAGSPSPTPAGQQVLDVDSCLDSSVLDSSFLTFSGLHAEQAFAGQMKSDLFLDDSKRLSILWLTIVIVGLTLVEVLGYLSLLCF

SEQ ID NO: 824183 - protein, 615 aa, Homo sapiens; identical to SEQ ID NO: 824180

SEQ ID NO: 824184 - protein, 615 aa, Homo sapiens; identical to SEQ ID NO: 824180

SEQ ID NO: 824185 - protein, 615 aa, Homo sapiens; identical to SEQ ID NO: 824180

SEQ ID NO: 824186 - protein, 615 aa, Homo sapiens; identical to SEQ ID NO: 824180

SEQ ID NO: 824187 - protein, 615 aa, Homo sapiens; identical to SEQ ID NO: 824180

SEQ ID NO: 824188 - protein, 615 aa, Homo sapiens; identical to SEQ ID NO: 824180

SEQ ID NO: 824189 - protein, 615 aa, Homo sapiens; identical to SEQ ID NO: 824180

SEQ ID NO: 824190 - protein, 615 aa, Homo sapiens; identical to SEQ ID NO: 824180

SEQ ID NO: 824191 - protein, 615 aa, Homo sapiens; identical to SEQ ID NO: 824180

SEQ ID NO: 824192 - protein, 615 aa, Homo sapiens; identical to SEQ ID NO: 824180

SEQ ID NO: 824193 - protein, 615 aa, Homo sapiens; identical to SEQ ID NO: 824180

SEQ ID NO: 824194 - protein, 615 aa, Homo sapiens; identical to SEQ ID NO: 824180

SEQ ID NO: 824195 - protein, 593 aa, Homo sapiens
GCGSAISHSTRSTGMILLVEALHSGVNSGVGFRADSHPDVPGSVPSATQTQSTPTSRQACDLRVSAPGRYLSEEPEPYLAVYLHSEPRPNERNCSASRRIRPESLQGADHRPYTFFISPGTRDPVGSYRLNLSSHFRWSALEVSVGLYTSLCQYFSEEDVVWRTEGLLPLEETSPRQAVCLTRHLTAFGTSLFVPPSHIRFVFPEPTADVNYIVMLTCAVCLVTYMVMAAILHKLDQLDASRGCAIPFCGQRGRFKYEILVKTGWGRGSGTTAHVGIMLYGVDSRSGHRHLDGDRAFHRNSLDIFQIATPHSLGSVWKIRVWHDNKGLYGPCQALPLCPCIGAPCEPDLPPAPLQGSALPGSCSTSSSGTCRRHAAPSSWSMTGFRWRRRPTGAWWRRRCWPRVRPRSVFPLRGRLGRVVLPRGLLQCGPPCLLGHAALLRFRRLLVAELQRGFFDKHIWLSIWDRPPRSCFTRIQRATCCVLLICLFLGANAVWYGAVGDSAYSTGRVSRLNPLSVDTVAVGLVSSVVVYPVYLAILFLFRMSRSKVGWGWGPGSTGNGAWASAPCPGPPLSSAAARGKGVHQRLLGKGQHT

SEQ ID NO: 824196 - protein, 248 aa, Homo sapiens
MRATRCRACSWMEAGEPGWWERGLVEKEVLAASHAALLRFRRLLVAELQRGFFDKHIWLSIWDRPPRSCFTRIQRATCCVLLICLFLGANAVWYGAVGDSAYSTGHVSRLSPLSVDTVAVGLVSSVVVYPVYLAILFLFRMSRSKVAGSLSPTPAGQQVLDIDSCLDSSVLDSSFLTFSGLHAEQAFAGQVKSDLFLDDSKSDLEEPWELRKEGAPRSRDRELVGEDQKSVETGFHRVRQDSLHVLTS

SEQ ID NO: 824197 - protein, 132 aa, Homo sapiens
PPGSRFARKPRVSVRDWTGVGCVCDTSPGTLLTRATCSLVCWPSSEGTPSWPDLLSDPSIVGSNLRHDPHLLGLSFYNQHNRNLGLLLFFFFFLRQSLIPFCHPGWSAMVRSRLTATSASQVQGIVLPQPPE

SEQ ID NO: 824198 - protein, 615 aa, Homo sapiens; identical to SEQ ID NO: 824180

SEQ ID NO: 824199 - protein, 615 aa, Homo sapiens; identical to SEQ ID NO: 824180

SEQ ID NO: 824200 - protein, 615 aa, Homo sapiens; identical to SEQ ID NO: 824180

SEQ ID NO: 824201 - protein, 615 aa, Homo sapiens; identical to SEQ ID NO: 824180

SEQ ID NO: 824202 - protein, 615 aa, Homo sapiens; identical to SEQ ID NO: 824180

SEQ ID NO: 824203 - protein, 615 aa, Homo sapiens; identical to SEQ ID NO: 824180

SEQ ID NO: 824204 - protein, 615 aa, Homo sapiens; identical to SEQ ID NO: 824180

SEQ ID NO: 824205 - protein, 615 aa, Homo sapiens; identical to SEQ ID NO: 824180

SEQ ID NO: 824206 - protein, 615 aa, Homo sapiens; identical to SEQ ID NO: 824180

SEQ ID NO: 824207 - protein, 615 aa, Homo sapiens; identical to SEQ ID NO: 824180

SEQ ID NO: 824208 - protein, 615 aa, Homo sapiens; identical to SEQ ID NO: 824180

SEQ ID NO: 824209 - protein, 615 aa, Homo sapiens; identical to SEQ ID NO: 824180

SEQ ID NO: 824210 - protein, 250 aa, Homo sapiens
MRATRCRACSWMEAGEPGWWERGLVEKEVLAASHAALLRFRRLLVAELQRGFFDKHIWLSIWDRPPRSCFTRIQRATCCVLLICLFLGANAVWYGAVGDSAYSTGHVSRLSPLSVDTVAVGLVSSVVVYPVYLAILFLFRMSRSKVAGSLSPTPAGQQVLDIDSCLDSSVLDSSFLTFSGLHAEVINTLADHRHRGTDFGGSPWLLIITVFLRSYKFAISLCTSYLCVSILTFCRGILVITNKNKLYETI

SEQ ID NO: 824211 - protein, 98 aa, Homo sapiens
ITQHLARNCTPGVVGILLASCRPPALLTACCAPCLPQYERALDVAAEPKHERQRRAQIRKNITETLVSLRVHTVDDIQQIAAALAQCMVGWPHMLSPP

SEQ ID NO: 824212 - protein, 482 aa, Homo sapiens
LPTRVQTLFFWGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 824213 - protein, 482 aa, Homo sapiens; identical to SEQ ID NO: 824212

SEQ ID NO: 824214 - protein, 482 aa, Homo sapiens; identical to SEQ ID NO: 824212

SEQ ID NO: 824215 - protein, 326 aa, Homo sapiens
LPTRVQTLFFWGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALTPLLLVEKCRIVCTFYEEKCNLQYSVRMLLLIFFSKV

SEQ ID NO: 824216 - protein, 482 aa, Homo sapiens; identical to SEQ ID NO: 824212

SEQ ID NO: 824217 - protein, 460 aa, Homo sapiens
LPTRVQTLFFWGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKVGAK

SEQ ID NO: 824218 - protein, 482 aa, Homo sapiens; identical to SEQ ID NO: 824212

SEQ ID NO: 824219 - protein, 488 aa, Homo sapiens
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHTGEKPFECKECGKAFGSGSNLTHHQRIHTGEKPYECKECGKAFSFGSGLIRHQIIHSGEKPYECKECGKSFSFESALIRHHRIHTGEKPYECIDCGKAFGSGSNLTQHRRIHTGEKPYECKACGMAFSSGSALTRHQRIHTGEKPYICNECGKAFSFGSALTRHQRIHTGEKPYVCKECGKAFNSGSDLTQHQRIHTGEKPYECKECEKAFRSGSKLIQHQRMHTGEKPYECKECGKTFSSGSDLTQHHRIHTGEKPYECKECGKAFGSGSKLIQHQLIHTGERPYECKECGKSFSSGSALNRHQRIHTGEKPYECKECGKAFYSGSSLTQHQRIHTGEKLYECKNCGKAYGRDSEFQQHKKSHNGKKLCELETIN

SEQ ID NO: 824220 - protein, 119 aa, Homo sapiens
MAVEHPQGTCKTSNFTLELSRNMACLFPQISLGLQTKGWNFEPISRLLVTVPEERQSYGYPPQALPETQLCVSSSYSLWSSDCKAISMPRQGLSWRAMEEDRPAGCRFCSRACTMREIF

SEQ ID NO: 824221 - protein, 101 aa, Homo sapiens
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGS

SEQ ID NO: 824222 - protein, 488 aa, Homo sapiens; identical to SEQ ID NO: 824219

SEQ ID NO: 824223 - protein, 488 aa, Homo sapiens; identical to SEQ ID NO: 824219

SEQ ID NO: 824224 - protein, 488 aa, Homo sapiens; identical to SEQ ID NO: 824219

SEQ ID NO: 824225 - protein, 488 aa, Homo sapiens; identical to SEQ ID NO: 824219

SEQ ID NO: 824226 - protein, 544 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFEDSEKESCPSSDEVDEEEEEDNYESDEDGDDYIIDDFVVQDEEGDEENKNQQGEKLTTSQLKLVKQNSLYSFSDHYTHFERVVKALLINALDESFLGTLYDGTRQKSYAKDMLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKENGWIKEKYGQLEEYLNFADYFQEEKFEL

SEQ ID NO: 824227 - protein, 544 aa, Homo sapiens; identical to SEQ ID NO: 824226

SEQ ID NO: 824228 - protein, 544 aa, Homo sapiens; identical to SEQ ID NO: 824226

SEQ ID NO: 824229 - protein, 544 aa, Homo sapiens; identical to SEQ ID NO: 824226

SEQ ID NO: 824230 - protein, 172 aa, Homo sapiens
MLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKENGWIKEKYGQLEEYLNFADYFQEEKFEL

SEQ ID NO: 824231 - protein, 544 aa, Homo sapiens; identical to SEQ ID NO: 824226

SEQ ID NO: 824232 - protein, 344 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFEDSEKESCPSSDEVDEEEEEDNYESDEDGDDYIIDDFVVQDEEGDEENKNQQGEKLTTSQLKLVKQNSLCKFNIKKMFHELFS

SEQ ID NO: 824233 - protein, 110 aa, Homo sapiens
MVYERAGEAVPPRGLREKFPRALFGWAGERPSALCASNPPQLSCSGRGARYFRLGEVLGTDVGSSVGDFSGFWPFQTLVIVFSVQSSFGVWGFPSSCARHREAWPEGPVS

SEQ ID NO: 824234 - protein, 110 aa, Homo sapiens; identical to SEQ ID NO: 824233

SEQ ID NO: 824235 - protein, 544 aa, Homo sapiens; identical to SEQ ID NO: 824226

SEQ ID NO: 824236 - protein, 544 aa, Homo sapiens; identical to SEQ ID NO: 824226

SEQ ID NO: 824237 - protein, 235 aa, Homo sapiens
CPEAGCRGRGGGGGRGGGALKDSFSDHYTHFERVVKALLINALDESFLGTLYDGTRQKSYAKDMLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKENGWIKEKYGQLEEYLNFADYFQEEKFEL

SEQ ID NO: 824238 - protein, 526 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFEDSEKESCPSSDEVDEEEEEDNYESDEDGDDYIIDDFVVQDEEGDEENKNQQGEKLTTSQLKLVKQNSLYSFSDHYTHFERVVKALLINALDESFLGTLYDGTRQKSYAKDMLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKADYFQEEKFEL

SEQ ID NO: 824239 - protein, 576 aa, Homo sapiens
MDVRFYPAAAGDPASLDFAQCLGYYGYSKFGNNNNYMNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 824240 - protein, 576 aa, Homo sapiens; identical to SEQ ID NO: 824239

SEQ ID NO: 824241 - protein, 669 aa, Homo sapiens
GRGSRAPRALGPGAPPAASPTRHPRAPSTVDLAAARRRVPAPANPSPGPRPRAQLRHGCEVLPRGGRGPCQPGLRAVPGVLRLQQAFCLQARICVVHCSLCSATEGTYPQHPTPIHLGLYKKFGNNNNYMNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 824242 - protein, 576 aa, Homo sapiens; identical to SEQ ID NO: 824239

SEQ ID NO: 824243 - protein, 114 aa, Homo sapiens
QRSELINMPADDLSPKSSPSRERQTNKNSRKEGGQAGWEGLSAARRRSAAGRGCGGLQGGRVRWRSGSGSGFVSAAGAGAGVALATASRSKPQPPPPPPPPEPTRRVQIPFVSS

SEQ ID NO: 824244 - protein, 536 aa, Homo sapiens
MDKVGKMWNNFKYRCQNLFGHEGGSRSENVDMNSNRCLSVKEKNISIGDSTPQQQSSPLRENIALQLGLSPSKNSSRRNQNCATEIPQIVEISIEKDNDSCVTPGTRLARRDSYSRHAPWGGKKKHSCSTKTQSSLDADKKFGRTRSGLQRRERRYGVSSVHDMDSVSSRTVGSRSLRQRLQDTVGLCFPMRTYSKQSKPLFSNKRKIHLSELMLEKCPFPAGSDLAQKWHLIKQHTAPVSPHSTFFDTFDPSLVSTEDEEDRLRERRRLSIEEGVDPPPNAQIHTFEATAQVNPLYKLGPKLAPGMTEISGDSSAIPQANCDSEEDTTTLCLQSRRQKQRQISGDSHTHVSRQGAWKVHTQIDYIHCLVPDLLQITGNPCYWGVMDRYEAEALLEGKPEGTFLLRDSAQEDYLFSVSFRRYNRSLHARIEQWNHNFSFDAHDPCVFHSSTVTGLLEHYKDPSSCMFFEPLLTISLNRTFPFSLQYICRAVICRCTTYDGIDGLPLPSMLQDFLKEYHYKQKVRVRWLEREPVKAK

SEQ ID NO: 824245 - protein, 536 aa, Homo sapiens; identical to SEQ ID NO: 824244

SEQ ID NO: 824246 - protein, 314 aa, Homo sapiens
MDKVGKMWNNFKYRCQNLFGHEGGSRSENVDMNSNRCLSVKEKNISIGDSTPQQQSSPLRENIALQLGLSPSKNSSRRNQNCATEIPQIVEISIEKDNDSCVTPGTRLARRDSYSRHAPWGGKKKHSCSTKTQSSLDADKKFGRTRSGLQRRERRYGVSSVHDMDSVSSRTVGSRSLRQRLQDTVGLCFPMRTYSKQSKPLFSNKRKIHLSELMLEKCPFPAGSDLAQKWHLIKQHTAPVSPHSTFFDTFDPSLVSTEDEEDRLRERRRPVVRDQPGQHGEIPSPQKKYKTSWAWWRVPPVPATREAEVRRQME

SEQ ID NO: 824247 - protein, 536 aa, Homo sapiens; identical to SEQ ID NO: 824244

SEQ ID NO: 824248 - protein, 536 aa, Homo sapiens; identical to SEQ ID NO: 824244

SEQ ID NO: 824249 - protein, 536 aa, Homo sapiens; identical to SEQ ID NO: 824244

SEQ ID NO: 824250 - protein, 858 aa, Homo sapiens
MFYHTSSWLKVLEDHMTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHSYMNVKWIPLSSDAQAPLAQPESPTASAGDEPRSTPESGDSDKESVGSSSTSNEGGRRKEKSKRDREKDKKRADSVANKLGSFGKTLGSKLKKNMGGLMHSKGSKPGGVGTGLGGSSGTETLEKKKKNSLKSWKGGKEEAAGDGPVSEKPPAESVGNGGSKYSQEVMQSLSILRTAMQGEGKFIFVGTLKMGHRHQYQEEMIQRYLSDAEERFLAEQKQKEAERKIMNGGIGGGPPPAKKPEPDAREEQPTGPPAESRAMAFSTGYPGDFTIPRPSGGGVHCQEPRRQLAGGPCVGGLPPYATFPRQCPPGRPYPHQDSIPSLEPGSHSKDGLHRGALLPPPYRVADSYSNGYREPPEPDGWAGGLRGLPPTQTKCKQPNCSFYGHPETNNFCSCCYREELRRREREPDGELLVHRF

SEQ ID NO: 824251 - protein, 858 aa, Homo sapiens; identical to SEQ ID NO: 824250

SEQ ID NO: 824252 - protein, 760 aa, Homo sapiens
MFYHTSSWLKVLEDHMTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHSYMNVKWIPLSSDAQAPLAQPESPTASAGDEPRSTPESGDSDKESVGSSSTSNEGGRRKEKSKRDREKDKKRADSVANKLGSFGKTLGSKLKKNMGGLMHSKGSKPGGVGTGLGGSSGTETLEKKKKNSLKSWKGGKEEAAGDGPVSEKPPAESVGNGGSKYSQEVMQSLSILRTAMQGEGKFIFVGTLKMGHRHQYQEEMIQRYLSDAEERFLAEQKQKEAERKIMNGGIGGGPPPAKKPEPDAREEQPTGPPAESRAMAFSTGYPGDFTIPRPSGGGVHCQEPRRQLAGGPCVGGLPPYATFPRSLGEEWAKEVLSQ

SEQ ID NO: 824253 - protein, 858 aa, Homo sapiens; identical to SEQ ID NO: 824250

SEQ ID NO: 824254 - protein, 858 aa, Homo sapiens; identical to SEQ ID NO: 824250

SEQ ID NO: 824255 - protein, 652 aa, Homo sapiens
GILPLCFFATGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHSYMNVKWIPLSSDAQAPLAQPESPTASAGDEPRSTPESGDSDKESVGSSSTSNEGGRRKEKSKRDREKDKKRADSVANKLGSFGKTLGSKLKKNMGGLMHSKGSKPGGVGTGLGGSSGTETLEKKKKNSLKSWKGGKEEAAGDGPVSEKPPAESVGNGGSKYSQEVMQSLSILRTAMQGEGKFIFVGTLKMGHRHQYQEEMIQRYLSDAEERFLAEQKQKEAERKIMNGGIGGGPPPAKKPEPDAREEQPTGPPAESRAMAFSTGYPGDFTIPRPSGGGVHCQEPRRQLAGGPCVGGLPPYATFPRQCPPGRPYPHQDSIPSLEPGSHSKDGLHRGALLPPPYRVADSYSNGYREPPEPDGWAGGLRGLPPTQTKCKQPNCSFYGHPETNNFCSCCYREELRRREREPDGELLVHRF

SEQ ID NO: 824256 - protein, 858 aa, Homo sapiens; identical to SEQ ID NO: 824250

SEQ ID NO: 824257 - protein, 219 aa, Homo sapiens
MFYHTSSWLKVLEDHMTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGES

SEQ ID NO: 824258 - protein, 281 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKEELYYYKPKVRGKTEGRLRLWALMAPSAECLAIVEEDTPRWPKSGRYVRPAGGREHKMRVGLY

SEQ ID NO: 824259 - protein, 376 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 824260 - protein, 376 aa, Homo sapiens; identical to SEQ ID NO: 824259

SEQ ID NO: 824261 - protein, 376 aa, Homo sapiens; identical to SEQ ID NO: 824259

SEQ ID NO: 824262 - protein, 376 aa, Homo sapiens; identical to SEQ ID NO: 824259

SEQ ID NO: 824263 - protein, 376 aa, Homo sapiens; identical to SEQ ID NO: 824259

SEQ ID NO: 824264 - protein, 376 aa, Homo sapiens; identical to SEQ ID NO: 824259

SEQ ID NO: 824265 - protein, 375 aa, Homo sapiens
MESTMRSQQPFVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 824266 - protein, 244 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPLVLPDSGPLSCSSGQI

SEQ ID NO: 824267 - protein, 376 aa, Homo sapiens; identical to SEQ ID NO: 824259

SEQ ID NO: 824268 - protein, 246 aa, Homo sapiens
LGEAGVIGRGSCSCFSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 824269 - protein, 376 aa, Homo sapiens; identical to SEQ ID NO: 824259

SEQ ID NO: 824270 - protein, 376 aa, Homo sapiens; identical to SEQ ID NO: 824259

SEQ ID NO: 824271 - protein, 311 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEVGGLPSFFGPLRSTKALGPTRILHQGLESGRPVPLHQACPTPGPWAARGPGWLSVRPNTKS

SEQ ID NO: 824272 - protein, 226 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKEVSAAPWA

SEQ ID NO: 824273 - protein, 174 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGCSSEKVCSWSLERHIAKCV

SEQ ID NO: 824274 - protein, 116 aa, Homo sapiens
KHQAVASHISRLPCPAEASHWPGMLWVGLFRFLTSVHEIIWEQVQSKSGQRSLWCKAGASLSSPAPSPVTPRPTPIPDFTQYSPPRRPMTKGPCQVWATAAGMCESNVAPRGLQCA

SEQ ID NO: 824275 - protein, 376 aa, Homo sapiens; identical to SEQ ID NO: 824259

SEQ ID NO: 824276 - protein, 376 aa, Homo sapiens; identical to SEQ ID NO: 824259

SEQ ID NO: 824277 - protein, 329 aa, Homo sapiens
MAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 824278 - protein, 297 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEISAPQERLYSTWIGGSILASLDTFKKMWVSKKEYEEDGARSIHRKTF

SEQ ID NO: 824279 - protein, 376 aa, Homo sapiens; identical to SEQ ID NO: 824259

SEQ ID NO: 824280 - protein, 132 aa, Homo sapiens
MGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 824281 - protein, 250 aa, Homo sapiens
MESYDVIANQPVVIDNEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEISAPQERLYSTWIGGSILASLDTFKKMWVSKKEYEEDGARSIHRKTF

SEQ ID NO: 824282 - protein, 261 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYCCGGPLGWAFRSGPGCFGH

SEQ ID NO: 824283 - protein, 219 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRLTSSPGPFYFLNSTWYEGFTSTIPYFKCTALNKPCPS

SEQ ID NO: 824284 - protein, 435 aa, Homo sapiens
MLCGFQEDATPPPPPRPRRLHRRLPRPEEVGMLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 824285 - protein, 449 aa, Homo sapiens
GGMLCGFQEDATPPPPPRPRRLHRRLPRPEEVGMLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQYEEEKFKKKQKRVDQELNGKQDEPKNEQ

SEQ ID NO: 824286 - protein, 435 aa, Homo sapiens; identical to SEQ ID NO: 824284

SEQ ID NO: 824287 - protein, 397 aa, Homo sapiens
FVFGSLAPHPVAFPFLVVVLGMEPCPSSAPPPFYPGVGEVAGLRWFSIYDQRPSWYRTKKLGLLDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 824288 - protein, 230 aa, Homo sapiens
GGMLCGFQEDATPPPPPRPRRLHRRLPRPEEVGMLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEVISWKDIFR

SEQ ID NO: 824289 - protein, 257 aa, Homo sapiens
FVFGSLAPHPVAFPFLVVVLGMEPCPSSAPPPFYPGVGEVAGLRWFSIYDQRPSWYRTKKLGLLDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGLLSVSCLKVVSLTIDT

SEQ ID NO: 824290 - protein, 126 aa, Homo sapiens
EETQRVTLGRGSHRTCSGGASWIPALLRSPPLAWVLFVFGSLAPHPVAFPFLVVVLGMEPCPSSAPPPFYPGVGEVAGLRWFSIYDQRPSWYRTKKLGLLVCLVTAGNRHGSSISNQGFNRSSLVR

SEQ ID NO: 824291 - protein, 435 aa, Homo sapiens; identical to SEQ ID NO: 824284

SEQ ID NO: 824292 - protein, 435 aa, Homo sapiens; identical to SEQ ID NO: 824284

SEQ ID NO: 824293 - protein, 230 aa, Homo sapiens; identical to SEQ ID NO: 824288

SEQ ID NO: 824294 - protein, 433 aa, Homo sapiens
GGMLCGFQEDATPPPPPRPRRLHRRLPRPEEVGMLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQYVLFYFLNCIGS

SEQ ID NO: 824295 - protein, 112 aa, Homo sapiens
MGTPKYPPNAGLTATPTRTHGHPVLRLQAQHMGSVSKPCFLLRPTASPVPLPVWSTLGFSAMPMQLAPSNPQAEWVNYALQSEGCHLPKPGTDWTCMLVNHLVLLSLGVSRL

SEQ ID NO: 824296 - protein, 126 aa, Homo sapiens
PRLARQARWSDDRPCVSKMAAAMDVDTPSGTNSGAGKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 824297 - protein, 126 aa, Homo sapiens; identical to SEQ ID NO: 824296

SEQ ID NO: 824298 - protein, 114 aa, Homo sapiens
PRAAGFGTRAMDVDTPSGTNSGAGKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 824299 - protein, 126 aa, Homo sapiens; identical to SEQ ID NO: 824296

SEQ ID NO: 824300 - protein, 126 aa, Homo sapiens; identical to SEQ ID NO: 824296

SEQ ID NO: 824301 - protein, 83 aa, Homo sapiens
PGCRIRHEAMDVDTPSGTNSGAGKKRFEVKKVGSRRAFLREAREARIWLAGPRMVEARSKGFHFRAFLGPVECSSPLGLGYCG

SEQ ID NO: 824302 - protein, 126 aa, Homo sapiens; identical to SEQ ID NO: 824296

SEQ ID NO: 824303 - protein, 126 aa, Homo sapiens; identical to SEQ ID NO: 824296

SEQ ID NO: 824304 - protein, 70 aa, Homo sapiens
PRLARQARWSDDRPCVSKMAAAMDVDTPSGTNSGAGKKRFEVKKWNAVALWAWDIVVDNCAICRNHIMDL

SEQ ID NO: 824305 - protein, 126 aa, Homo sapiens; identical to SEQ ID NO: 824296

SEQ ID NO: 824306 - protein, 106 aa, Homo sapiens
PRLARQARWSDDRPCVSKMAAAMDVDTPSGTNSGAGKKRFEVKKWNAVALWAWDIVVDNCAICRNHIMDLCIECQANQASATSEECTVAWGVCNVWALGKDFFHQA

SEQ ID NO: 824307 - protein, 336 aa, Homo sapiens
MLPAVAVSEPVVLRFMIFCRLLAKMANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 824308 - protein, 336 aa, Homo sapiens; identical to SEQ ID NO: 824307

SEQ ID NO: 824309 - protein, 203 aa, Homo sapiens
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEILAPPNGSVPGDRITFDAFPGEPDKELNPKKKIWEQIQPDLHTNDECVATYKGVPFEVKGKGVCRAQTMSNSGIK

SEQ ID NO: 824310 - protein, 336 aa, Homo sapiens; identical to SEQ ID NO: 824307

SEQ ID NO: 824311 - protein, 336 aa, Homo sapiens; identical to SEQ ID NO: 824307

SEQ ID NO: 824312 - protein, 312 aa, Homo sapiens
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 824313 - protein, 312 aa, Homo sapiens; identical to SEQ ID NO: 824312

SEQ ID NO: 824314 - protein, 107 aa, Homo sapiens
MNYHSKRFDWLHNGRQGAKINEIRQMSGAQIKIANPVEGSTDRQVTITGSAAREPDKELNPKKKIWEQIQPDLHTNDECVATYKGVPFEVKGKGVCRAQTMSNSGIK

SEQ ID NO: 824315 - protein, 84 aa, Homo sapiens
TLHHPTTHTTPPPPLLSPSPIHPKMLTYTRTQPPKFQVTLNFWEESHGSSHTPQNLITVKMEQAFARYLLEQTPEQQAAILSLV

SEQ ID NO: 824316 - protein, 393 aa, Homo sapiens
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 824317 - protein, 221 aa, Homo sapiens
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPGTWHF

SEQ ID NO: 824318 - protein, 279 aa, Homo sapiens
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDLVRYFQGLGPPPKFQVTLNFWEESHGSSHTPQNLITVKMEQAFARYLLEQTPEQQAAILSLV

SEQ ID NO: 824319 - protein, 291 aa, Homo sapiens [sequence omitted]

SEQ ID NO: 824320 - protein, 317 aa, Homo sapiens
IGSVPNLDSCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 824321 - protein, 421 aa, Homo sapiens
AGTGPSRFDALRQPGQQLRMASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPAPGRAVLSPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 824322 - protein, 221 aa, Homo sapiens; identical to SEQ ID NO: 824317

SEQ ID NO: 824323 - protein, 191 aa, Homo sapiens
MIPTQGELQLRSELHYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 824324 - protein, 145 aa, Homo sapiens
MIESSRYQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 824325 - protein, 105 aa, Homo sapiens
MHGTPALVCCISCVAICPAWQLPGSSPPAKTMEEVVQVEPSTRVSYLGEHHHTEACSHYVKVHRRIGTEILSLMAFSYVHTFGRAGTHHTHWPWVHRLYHTPGMP

SEQ ID NO: 824326 - protein, 393 aa, Homo sapiens; identical to SEQ ID NO: 824316

SEQ ID NO: 824327 - protein, 291 aa, Homo sapiens [sequence omitted]

SEQ ID NO: 824328 - protein, 140 aa, Homo sapiens [sequence omitted]

SEQ ID NO: 824329 - protein, 177 aa, Homo sapiens
MDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDLVRYFQGLGPPPKFQVTLNFWEESHGSSHTPQNLITVKMEQAFARYLLEQTPEQQAAILSLV

SEQ ID NO: 824330 - protein, 611 aa, Homo sapiens
QRRRRNTPGWSGFQGLTRAPALFPRLIFQSSSETRLLSGTLLWIPRAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824331 - protein, 489 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824332 - protein, 595 aa, Homo sapiens
WGGRAGVVSVKESSPGAELAAPSAASPAARGELRTARGPGSGSRSARPPSRRGRHRRGASPGDRAPGPRLRPGTEEPALDTESSSETRLLSGTLLWIPRAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824333 - protein, 504 aa, Homo sapiens
SRGLALDAAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824334 - protein, 584 aa, Homo sapiens
MLSVTIYLLQIGSFIVIANFWLKSLLRSIPEHKRTSDLFLLKGIQSKANKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824335 - protein, 510 aa, Homo sapiens
MTEMYDEEVNDHINELMQISEEMYARDEVVNACCVITGQRDCKNAKCAHDVVVDKDRSSSTTILTEAEMYSRLSLDGGKEISVLEEPAKGTSVLVCMNGKEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824336 - protein, 297 aa, Homo sapiens
LARSALRLSVEPPSNRAGKIPTRSALQWTPEEQSERIHGGALVISVIMGFLLFISFLQHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824337 - protein, 558 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824338 - protein, 137 aa, Homo sapiens
MPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824339 - protein, 447 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNSTVEHVGIV

SEQ ID NO: 824340 - protein, 375 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNTIPQTPRPIGILYNAS

SEQ ID NO: 824341 - protein, 295 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKTISLSP

SEQ ID NO: 824342 - protein, 117 aa, Homo sapiens
AAAYYYKIRGRVDLGCVLLSSSETRLLSGTLLWIPRAYSTRSKMAELNTHVNVKEKIYAVRSVVPNKSNNEIVLVLQQFDFNVDKAVQAFVDGRYTCTLQLKMLDLNIPDIPYFFLK

SEQ ID NO: 824343 - protein, 64 aa, Homo sapiens
MAELNTHVNVKEKIYAVRSVVPNKSNNEIVLVLQQFDFNVDKAVQAFVDASAIPVPKKVISGRK

SEQ ID NO: 824344 - protein, 558 aa, Homo sapiens; identical to SEQ ID NO: 824337

SEQ ID NO: 824345 - protein, 104 aa, Homo sapiens
WGGRAGVVSVKESSPGAELAAPSAASAGSAGRAPDGARPRQRLPLGPPSEPQGPPPPRRLPWRPRPRAPAPARDGGAGARHRELFRNQAAFRNIAVDSQLSDNT

SEQ ID NO: 824346 - protein, 664 aa, Homo sapiens
WGGRAGVVSVKESSPGAELAAPSAASPAARGELRTARGPGSGSRSARPPSRRGRHRRGASPGDRAPGPRLRPGTEEPALDTESSSETRLLSGTLLWIPRAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824347 - protein, 563 aa, Homo sapiens
ARIQASNDVRGHVNVKEEIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824348 - protein, 318 aa, Homo sapiens
MIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824349 - protein, 281 aa, Homo sapiens
CLDDPWPCCTARWLILEELAIFTELDADMGQMYVVVVIAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 824350 - protein, 558 aa, Homo sapiens; identical to SEQ ID NO: 824337

SEQ ID NO: 824351 - protein, 370 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRSRIAIS

SEQ ID NO: 824352 - protein, 137 aa, Homo sapiens; identical to SEQ ID NO: 824338

SEQ ID NO: 824353 - protein, 117 aa, Homo sapiens; identical to SEQ ID NO: 824342

SEQ ID NO: 824354 - protein, 105 aa, Homo sapiens
MGETEGKKDEADYKRLQTFPLVRHSDMPEEMRVETMELCVTACEKFSNNNESAAKMIKETMDKKFGSSWHVVIGEGFGFEITHEVKNLLYLYFGGTLAVCVWKCS

SEQ ID NO: 824355 - protein, 89 aa, Homo sapiens
GRTSLLVAKTLLFRSLTTLAGVRWLRPRLRPPQEQSAAKMIKETMDKKFGSSWHVVIGEGFGFEITHEVKNLLYLYFGGTLAVCVWKCS

SEQ ID NO: 824356 - protein, 107 aa, Homo sapiens [sequence omitted]

SEQ ID NO: 824357 - protein, 299 aa, Homo sapiens
MPGSASKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 824358 - protein, 283 aa, Homo sapiens
MADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 824359 - protein, 283 aa, Homo sapiens; identical to SEQ ID NO: 824358

SEQ ID NO: 824360 - protein, 327 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMFPLLPGAVAHACNPSTLGGRGGRITRSGRCG

SEQ ID NO: 824361 - protein, 372 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGGVPPPFTPAPALGPCPHTASSPSPRMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 824362 - protein, 265 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVG

SEQ ID NO: 824363 - protein, 334 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMFPFCRAQLVPGPTHRDPLSCCVCQDLQSTGCPPSSSRR

SEQ ID NO: 824364 - protein, 175 aa, Homo sapiens
MADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQMECVQLTGGPPLTYAGPLSDGSASWGCRDRCSTLGWGPPFRGGLTMVTAQIGCNGGHPTLGASAFVSPHSFL

SEQ ID NO: 824365 - protein, 347 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 824366 - protein, 330 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMFPLLPGAVAHACNPSTLGGRGGRITRSGDQDHPG

SEQ ID NO: 824367 - protein, 283 aa, Homo sapiens; identical to SEQ ID NO: 824358

SEQ ID NO: 824368 - protein, 347 aa, Homo sapiens; identical to SEQ ID NO: 824365

SEQ ID NO: 824369 - protein, 270 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGSGRCG

SEQ ID NO: 824370 - protein, 248 aa, Homo sapiens
PSLNPDVHWLSLRRRGVGTGAGRARSEPRLRWRRRRMHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLPMLMYWLTFHLVR

SEQ ID NO: 824371 - protein, 141 aa, Homo sapiens
RDGSGLGGVGGGSARGDVRGGAARAVGGGGGSVSRSRVEVGRSELLGAVSPPAASARLYRRASEFPRVLGGAPPSFQSPRTGPSSFYLTAPVFRRLLALSVGPIPARFLLLPIEALEMNVSISSEMNQIMMHHYHRRNSCL

SEQ ID NO: 824372 - protein, 221 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVY

SEQ ID NO: 824373 - protein, 464 aa, Homo sapiens
CNQDMEEMMSEQENPDSVKQQSCPSSPKKNPLWAENDDDLMVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 824374 - protein, 642 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 824375 - protein, 302 aa, Homo sapiens [sequence omitted]

SEQ ID NO: 824376 - protein, 203 aa, Homo sapiens
TCSSLKIPELRTNRLNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 824377 - protein, 642 aa, Homo sapiens; identical to SEQ ID NO: 824374

SEQ ID NO: 824378 - protein, 642 aa, Homo sapiens; identical to SEQ ID NO: 824374

SEQ ID NO: 824379 - protein, 564 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNENCLWR

SEQ ID NO: 824380 - protein, 221 aa, Homo sapiens; identical to SEQ ID NO: 824372

SEQ ID NO: 824381 - protein, 141 aa, Homo sapiens; identical to SEQ ID NO: 824371

SEQ ID NO: 824382 - protein, 642 aa, Homo sapiens; identical to SEQ ID NO: 824374

SEQ ID NO: 824383 - protein, 642 aa, Homo sapiens; identical to SEQ ID NO: 824374

SEQ ID NO: 824384 - protein, 424 aa, Homo sapiens
MVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 824385 - protein, 630 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 824386 - protein, 561 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGNV

SEQ ID NO: 824387 - protein, 302 aa, Homo sapiens [sequence omitted]

SEQ ID NO: 824388 - protein, 642 aa, Homo sapiens; identical to SEQ ID NO: 824374

SEQ ID NO: 824389 - protein, 625 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEV

SEQ ID NO: 824390 - protein, 378 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGYTCE

SEQ ID NO: 824391 - protein, 506 aa, Homo sapiens
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 824392 - protein, 506 aa, Homo sapiens; identical to SEQ ID NO: 824391

SEQ ID NO: 824393 - protein, 506 aa, Homo sapiens; identical to SEQ ID NO: 824391

SEQ ID NO: 824394 - protein, 406 aa, Homo sapiens
MKQNLILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 824395 - protein, 485 aa, Homo sapiens [sequence omitted]

SEQ ID NO: 824396 - protein, 415 aa, Homo sapiens [sequence omitted]

SEQ ID NO: 824397 - protein, 239 aa, Homo sapiens
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCHCLTWIFYDFT

SEQ ID NO: 824398 - protein, 506 aa, Homo sapiens; identical to SEQ ID NO: 824391

SEQ ID NO: 824399 - protein, 506 aa, Homo sapiens; identical to SEQ ID NO: 824391

SEQ ID NO: 824400 - protein, 506 aa, Homo sapiens; identical to SEQ ID NO: 824391

SEQ ID NO: 824401 - protein, 506 aa, Homo sapiens; identical to SEQ ID NO: 824391

SEQ ID NO: 824402 - protein, 506 aa, Homo sapiens; identical to SEQ ID NO: 824391

SEQ ID NO: 824403 - protein, 253 aa, Homo sapiens
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVGMIFFLEKIFYKPCHVT

SEQ ID NO: 824404 - protein, 506 aa, Homo sapiens; identical to SEQ ID NO: 824391

SEQ ID NO: 824405 - protein, 406 aa, Homo sapiens; identical to SEQ ID NO: 824394

SEQ ID NO: 824406 - protein, 506 aa, Homo sapiens; identical to SEQ ID NO: 824391

SEQ ID NO: 824407 - protein, 444 aa, Homo sapiens
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGKF

SEQ ID NO: 824408 - protein, 506 aa, Homo sapiens; identical to SEQ ID NO: 824391

SEQ ID NO: 824409 - protein, 506 aa, Homo sapiens; identical to SEQ ID NO: 824391

SEQ ID NO: 824410 - protein, 506 aa, Homo sapiens; identical to SEQ ID NO: 824391

SEQ ID NO: 824411 - protein, 506 aa, Homo sapiens; identical to SEQ ID NO: 824391

SEQ ID NO: 824412 - protein, 506 aa, Homo sapiens; identical to SEQ ID NO: 824391

SEQ ID NO: 824413 - protein, 506 aa, Homo sapiens; identical to SEQ ID NO: 824391

SEQ ID NO: 824414 - protein, 444 aa, Homo sapiens; identical to SEQ ID NO: 824407

SEQ ID NO: 824415 - protein, 80 aa, Homo sapiens
SDIRNGIKFIREVTPYIKKPSLVSDLPWEGAAPQSPSFSGSEDSGSPKHQNSTKDRKIIPLKMCFAARNLSMPDLENRQN

SEQ ID NO: 824416 - protein, 525 aa, Homo sapiens [sequence omitted]

SEQ ID NO: 824417 - protein, 525 aa, Homo sapiens [sequence omitted]

SEQ ID NO: 824418 - protein, 1029 aa, Homo sapiens
MLSEERSRESSCLLDGSRVPRKNVSAVEGGGGCHFRWGRHRGRKEEKNTPVCKMSYLVSVRPDRWGGPMSRESSEVNIVTPLSSFTHKSVLLPHYSETNKYAEVGERCLFFPQLHIIVKVPKMNYLNCLKLEIKIKTRICLSRAFYVLKVHKPKIGSISDKFSFLFFFETESRSVSQAGVQWHDLGSLQPPPPEVQVILLSSWGYSYPPPHPANFCIFSRGRFSPCWLAGLELPTSSDPPALASQSAGIIGVSPRAWPTINFHFREGKKSLERPEMISGIRISICNDPQVGNLEPSMQGEHYYYEMLNDAFTDFSSKAIWLRFSVLMWKAKPLRFAGELLSHPACWLYEDVKEVELKCEQERQGMCAFSLILVKVKLTCIALRSVGFLISFESCCEMKVWEVSFVHEQPQEPEPFCCFSYIPNSSPVMMTKVVLQSNVLWDFQSANEVLSNEWDTMINMYLYLDAKVMANYFQMITTNGNFRYSTFFIEPAHFSFLFHFELRKLLRMWWVPVCGMERKLQNSVCSPFRGTASCAPQTRGFTASPHSTQMPRSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPELFFFFLLFFWRQVLTLSPRLECSGMIIADCSLNLLGSNDPFTSASWVAGTTGVCHHTWLIFMDFFSFFFFAMLPRLVLNSWHSSSPSASASQSAGITDVSHCTWPQKLCLKKKLSCVESGQGYVSPRNRFCCKWFLMGESVRKGYNRFFVFNFVRNSRSSCLTYMHVDIFVFKAMEESLFIYFNANYLVCCYANSIKRPTCLRIKQFLKLSGKTCRLKHFLCFFVSYLGHLCWIMFLLFSLVISYSLYIIFKLSKYPAYISMWLPSAVDAMNEMAG

SEQ ID NO: 824419 - protein, 1376 aa, Homo sapiens
MKPAIPHKRHVELFWAAQKQQDAASWLWPGPLWQQWHGQATANSRLTIGFTAHPTVSRVMRPWNSYLLLVKIARYHSGHSSSKNADFVVLENELSLFFLILKVVYICKHLKWLISYKMSKLAQSLDLKEEVILTWMFFMLSEERSRESSCLLDGSRVPRKNVSAVEGGGGCHFRWGRHRGRKEEKNTPVCKMSYLVSVRPDRWGGPMSRESSKVNIVTPLSSFTHKSVLLPHYSETNKYAEVGERCLFFPQLHIIVKVPKMNYLNCLKLEIKIKTRICLSRAFYVLKVHKPKIGSISDKFSFLFFFETESRSVSQAGVQWHDLGSLQPPPPEVQVILLSSWGYSYPPPHPANFCIFSRGRFSPCWLAGLELPTSSDPPALASQSAGIIGVSPRAWPTINFHFREGKKSLERPEMISGIRISICNTLRKAILNPLCSESIIEYEMLNDAFTDFSSKAIWLRFSVLMWKAKPLRFAGELLSHPACWLYEDVKEVELKCEQERQGMCAFSLILVKVKLTCIALRSVGFLISFESCCEMKVWEVSFVHEQPQEPEPFCCFSYIPNSSPVMMTKVVLQSNVLWDFQSANEVLSNEWDTMINMYLYLDAKVMANYFQMITTNGNFRYSTFFIEPAHFSFLFHFELRKLLRMWWVPVCGMERKLQNSVCSPFRGTASCAPQTRGFDASPHSTQMPRSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPEFVLFFPSFFLETGSHSVTEVGVQWYDHELTAASTFWAQMILSPQPPESAGTTGVCHHTWLIFMDFFFFFFFRHVAQAGLELLALKQSFCLSLPKCWDYRCEPLHLAPEIMLKKKIKLLWNLDKAMFLLETGFAVNGFDGRKCEKKVIIDSFFNFVRNSRSSCLTYMHVDIFVFKAMEESLFIYFNANYLVCCYANSIKRPTCLRIKHFGNFQGRPVDSSTFSAFLYLILDTYAEFMFLLFSLVISYSLYIIFKLSKYPAYISMWLPSAVDAMNEMAGEKAKGLLFSIPNEEVKCQISLVSKQIALIRSNIYVMKRDLLKFGILLKLYVEFDCSHSFFLYISVRYDIELPGGIILYFEFGHHFQLNFCCYCGFFFFLTPLKMEVEQSAISCCSFSVPPNCLVIKNYSDFPHTVFKNQIVAICPPPPFKLNLSLCWIHRHSINVDDSSKIIMLYIRVLYFGAISLFLCCDVKWNLFYTSNRLLKWLI

SEQ ID NO: 824420 - protein, 525 aa, Homo sapiens [sequence omitted]

SEQ ID NO: 824421 - protein, 252 aa, Homo sapiens
MAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRQN

SEQ ID NO: 824422 - protein, 246 aa, Homo sapiens [sequence omitted]

SEQ ID NO: 824423 - protein, 1292 aa, Homo sapiens
MADFVVLENELSLFFLILKVVYICKHLKWLISYKMSKLAQSLDLKELGNIDLDVLYALLKKGLGKVLVCLIDQECQRKNVSAVEGGGGCHFRWGRHRGRKEEKNTPVCKMSYLVSVRPDRWGGPMSRESSEVNIVTPLSSFTHKSVLLPHYSETNKYAEVGERCLFFPQLHIIVKVPKMNYLNCLKLEIKIYTRICLSRAFYVLKVHKPKIGSISDKFSFLFFFETESRSVSQAGVQWHDLGSLQPPPPEVQVILLSSWGYSYPPPHPANFCIFSRGRFSPCWLGWFELPTSSDPPALASQSAGIIGVSPRAWPTINFHFREGKKSLERPEMISGIRISICNTLRKAILNPLCSESIITYEMLNDAFTDFSSKAIVVEVFCVNVKSSATEICRGASEPPCLWLYEDVKEVELKCEQERQGMCAFSLILVKVKLTCIALRSVGFLISFESCCEMKVWEVSLSISSPKNQNPFAAFLTYLTALHHDDQGCSSIKCVCGIFSPQMKCSLMNGHHDKYVFIFRCQSMANYFQMITTNGNFRYSTFFIEPAHFSFLFHFELRKLLRMWWVPVCGMERKLQNSVCSPFRGTASCAPQTRGFDSFSTFHTDAWSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPELFFFFLLFFWRQVLTLSPRLECSGMIIADCSLNLLGSNDPFTSASWVAGTTGVCHHTWLIFMDFFSFFFSAMLPRLVLNSWHSSSPSASASQSAGITDVSHCTWPQKLCLKKKLSCVESGQGYVSPRNRFCCKWFLMGESVRKGYNRFFFYNFVRNSRSSCLTYMHVDIFVFKAMEESLFIYFNANYLVCCYANSIKRPTCLRIKHFGNFQGRPVDSSTFSAFLYLILDTYAEFMFLLFSLVISYSLYIIFKLSKYPAYISMWLPSAVDAMNEMAGEKAKGLLFSIPNEEVKCQISLVSKQIALIRSNIYVMKRDLLKFGILLKLYVEFDCSHSFFLYISVRYDIELPGGIILYFEFGHHFQLNFCCYCGFFFFLTPLKMEVEQSAISCCSFSVPPNCLVIYNYSDFPHTVFKNQIVAICPPPPFKLNLSLCWIHRHSKMCDDSSKIIMLYIRVLYFGAISLFLCCDVKWNLFYTSNRLLKWLI

SEQ ID NO: 824424 - protein, 1024 aa, Homo sapiens
MPRKNVSAVEGGGGCHFRWGRHRGRKEEKNTPVCKMSYLVSVRPDRWGGPMSRESSEVNIVTPLSSFTHKSVLLPHYSETNTYAEVGERCLFFPQLHIIVKVPKMNYLNCLKLEIKIYDKNMSFKSFLCFEEFINLRLAPSEINFLFFFFLRRSLVLSPRLECSGMISAHCNLHLLGSSDSPEYAGVIATHHHTQLIFVFLVEAGFHHVGKAGLELPTSSDPPALASQSAGIIGVSPRAWPTINFHFREGKKSLERPEMISGIRISICNTLRKAILNPLCSESIIEYEMLNDAFTDFSSKAIWLRFSVLMWKAKPLRFAGELLSHPACWLYEDVKYVELKCEQERQGMCAFSLILVKVKLTCIALRSVGFLISFESCCEMKVWEVSLSISSPKNQNPFAAFLTYLTALHHDDQGCSSIKCVCGIFSPQMKCSLMNGHHDKYVFIFRCQSMANYFQMITTNGNFRYSTFFIEPAHFSFLFHFELRKLLRMWWVPVCGMERKLQNSVCSPFRGTASCAPQTRGFTASPHSTQMPRSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPELFFFFLLFFWRQVLTLSPRLECSGMIIADCSLNLLGSNDPFTSASWVAGTTGVCHHTWLIFMDFFFFFFFRHVAQAGLELLALKQSFCLSLPKCWDYRCEPLHLAPEIMLKKKIKLLWNLDKAMFLLETGFAVNGFDGRKCEKKVIIDSFFNFVRNSRSSCLTYMHVDIFVFKAMEESLFIYFNANYLVCCYANSIKRPTCLRIKHFGNFQGRPVDSSTFSAFLYLILDTYAEFMFLLFSLVISYSLYIIFKLSKYPAYISMWLPSAVDAMNEMAGEKAKGLLFSIPNE

SEQ ID NO: 824425 - protein, 1317 aa, Homo sapiens
MRPWNSYLLLVKIARYHSGHSSSKNADFVVLENELSLFFLILKVVYICKHLKWYNIIENVKISTVPGSQRIGNIDLDVLYALLKKGLGKVLVCLIDQECQRKNVSAVEGGGGCHFRWGRHRGRKEEKNTPVCKMSYLVSVRPDRWGGPMSRESSEVNIVTPLSSFTHKSVLLPHYSETNKYAEVGERCLFFPQLHIIVKVPKMNYLNCLKLEIKIKTRICLSRAFYVLKVHKPKIGSISDKFSFLFFFETESRSVSQAGVQWHDLGSLQPPPPEVQVILLSSWGYSYPPPHPANFCIFSRGRFSPCWLAGLELPTSSDPPALASQSAGIIGVSPRAWPTINFHFREGKKSLERPEMISGIRISICNTLRKAILNPLCSESIIEYEMLNDAFTDFSSKAIWLRFSVLMWKAKPLRFAGELLSHPACWLYEDVKEVELKCEQERQGMCAFSLILVKVKLTCIALRSVGFLISFESCCEMKVWEVSFVHEQPQEPEPFCCFSYIPNSSPVMMTKVVLQSNVLWDFQSANEVLSNEWDTMINMYLYLDAKSMANYFQMITTNGNFRYSTFFIEPAHFSFLFHFELRKLLRMWWVPVCGMERKLQNSVCSPFRGTASCAPQTRGFDASPHSTQMPRSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPELFFFFLLFFWRQVLTLSPRLECSGMIIADCSLNLLGSNDPFTSASWVAGTTGVCHHTWLIFMDFFFFFFFRHVAQAGLELLALKQSFCLSLPKCWDYRCEPLHLAPEIMLKKKIKLLWNLDKAMFLLETGFAVNGFDGRKCEKKVIIDSFFNFVRNSRSSCLTYMHVDIFVFKAMEESLFIYFNANYLVCCYANSIKRPTCLRIKHFSNFQGRPVDSSTFSAFLYLILDTYAELCSYYFQLVISYSLYIIFKLSKYPAYISMWLPSAVDAMNEMAGEKAKGLLFSIPNEEVKCQISLVSKQIALIRSNIYVMKRDLLKFGILLKLYVEFDCSHSFFLYISVRYDIELPGGIILYFEFGHHFQLNFCCYCGFFFFLTPLKMEVEQSAISCCSFSVPPNCLVIKNYSDFPHTVFKNQIVAICPPPPFKLNLSLCWIHRHSINVDDSSKIIMLYIRVLYFGAISLFLCCDVKWNLFYTSNRLLKWLI

SEQ ID NO: 824426 - protein, 1138 aa, Homo sapiens
MAEVGERCLFFPQLHIIVKVPKMNYLNCLKLEIKIKTRICLSRAFYVLKVHKPKIGSISDKFSFLFFFETESRSVSQAGVQWHDLGSLQPPPPEVQVILLSSWGYSYPPPHPANFCIFSRGRFSPCWLAGLELPTSSDPPALASQSAGIIGVSPRAWPTINFHFREGKKSLERPEMISGIRISICNTLRKAILNPLCSESIIEYEMLNDAFTDFSSKAIWLRFSVLMWKAKPLRFAGELLSHPACWLYEDVKEVELKCEQERQGMCAFSLILVKVKLTCIALRSVGFLISFESCCEMKVWEVSFVHEQPQEPEPFCCFSYIPNSSPVMMTKVVLQSNVLWDFQSANEVLSNEWDTMINMYLYLDAKVMANYFQMITTNGNFRYSTFFIEPAHFSFLFHFELRKLLRMWWVPVCGMERKLQNSVCSPFRGTASCAPQTRGFDASPHSTQMPRSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPEFVLFFPSFFLETGSHSVTEVGVQWYDHELTAASTFWAQMILSPQPPESAGTTGVCHHTWLIFMDFFFFFFFRHVAQAGLELLALKQSFCLSLPKCWDYRCEPLHLAPEIMLKKKIKLLWNLDKAMFLLETGFAVNGFDGRKCEKKVIIDSFFNFVRNSRSSCLTYMHVDIFVFKAMEESLFIYFNANYLVCCYANSIKRPTCLRIKHFGNFQGRPVDSSTFSAFLYLILDTYAEFMFLLFSLVISYSLYIIFKLSKYPAYISMWLPSAVDAMNEMAGEKAKGLLFSIPNEEVKCQISLVSKQIALIRSNIYVMKRDLLKFGILLKLYVEFDCSHSFFLYISVRYDIELPGGIILYFEFGHHFQLNFCCYCGFFFFLTPLKMEVEQSAISCCSFSVPPNCLVIKNYSDFPHTVFKNQIVAICPPPPFKLNLSLCWIHRHSINVDDSSKIIMLYIRVLYFGAISLFLCCDVKWNLFYTSNRLLKWLI

SEQ ID NO: 824427 - protein, 985 aa, Homo sapiens
MLARLVLNSRPQVIHLPWLPKCWDYRCEPPCLAHNKFHFREGKKSLERPEMISGIRISICNTLRYAILNPLCSESIIEYEMLNDAFTDFSSKAIVVEVFCVNVKSKPLRFAGELLSHPACWLYEDVKEVELKCEQERQGMCAFSLILVKVKLTCIALRSVGFLISFESCCEMKVWEVSFVHEQPQEPEPFCCFSYIPNSSPVMMTKVVLQSNVLWDFQSANEVLSNEWDTMINMYLYLDAKVMANYFQMITTNGNFRYSTFFIEPAHFSFLFHFELRKLLRMWWVPVCGMERKLQNSVCSPFRGTASCAPQTRGFDSFSTFHTDAWSSELVYEKSPTFSPKTSLLSLHKKKRKGTKEKHSVFLFLKKVSPFLKSSNEDIIWKLVSNVVYEEILKYKFLQYLLDSCNCKLTSLVDKSFRLNTGTYIGSQKYYFKCHSPILKPCFSTFQAKEGLIVPVFMFCTLTNFVTQNYCMAGEIGLFISYIFISKKIFLNNKYLTLLLIVFLIYPPKLNGNKAFPAEGMHLADKPELFFFFLLFFWRQVLTLSPRLECSGMIIADCSLNLLGSNDPFTSASWVAGTTGVCHHTWLIFMDFFSFFFSAMLPRLVLNSWHSSSPSASASQSAGITDVSHCTWPQKLCLKKKLSCVESGQGYVSPRNRFCCKWFLMGESVRKGYNRFFVFNFVRNSRSSCLTYMHVDIFVFKAMEESLFIYFNANYLVCCYANSIKRPTCLRIKHFGNFQGRPVDSSTFSAFLYLILDTYAEFMFLLFSLVISYSLYIIFKLSKYPAYISMWLPSAVDAMNEMAGYKAKGLLFSIPNEEVKCQISLVSKQIALIRSNIYVMKRDLLKFGILLKLYVEFDCSHSFFLYISVRYDIELPGGIILYFEFGHHFQLNFCCYCGFFFFLTPLKMEVEQSAISCCSFSVPPNCLVIYNYSDFPHTVFKNQIVAICPPPPFKLNLSLCWIHRHSKMCDDSSKIIMLYIRVLYF

SEQ ID NO: 824428 - protein, 709 aa, Homo sapiens
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 824429 - protein, 482 aa, Homo sapiens
MIGYGAILVALAGLLMTLPHFISEPYRYDNTSPGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 824430 - protein, 709 aa, Homo sapiens; identical to SEQ ID NO: 824428

SEQ ID NO: 824431 - protein, 709 aa, Homo sapiens; identical to SEQ ID NO: 824428

SEQ ID NO: 824432 - protein, 709 aa, Homo sapiens; identical to SEQ ID NO: 824428

SEQ ID NO: 824433 - protein, 709 aa, Homo sapiens; identical to SEQ ID NO: 824428

SEQ ID NO: 824434 - protein, 233 aa, Homo sapiens
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQHLGQRPTHYRTRSQRKPSSPPPLASG

SEQ ID NO: 824435 - protein, 687 aa, Homo sapiens
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 824436 - protein, 709 aa, Homo sapiens; identical to SEQ ID NO: 824428

SEQ ID NO: 824437 - protein, 406 aa, Homo sapiens
CAISSSLECLRPSRLPSPSFLNTGLGPTALGVLGGAGAGLMSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 824438 - protein, 450 aa, Homo sapiens
CAISSSLECLRPSRLPSPSFLNTGLGPTALGVLGGAGAGLMSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDGQQSFGKSLLCRRPELLPVHLPTPLPSSPAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 824439 - protein, 49 aa, Homo sapiens
MPPMKPRNLSPSQPGQIAWPGNMPRSASSSSEKQRDPVDPHVLRAPARA

SEQ ID NO: 824440 - protein, 421 aa, Homo sapiens
CAISSSLECLRPSRLPSPSFLNTGLGPTALGVLGGAGAGLMSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 824441 - protein, 169 aa, Homo sapiens
CAISSSLECLRPSRLPSPSFLNTGLGPTALGVLGGAGAGLMSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAME

SEQ ID NO: 824442 - protein, 903 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 824443 - protein, 681 aa, Homo sapiens
GGKNDYHNLMSRTHPSGERGFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 824444 - protein, 685 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQVWKPSFCFK

SEQ ID NO: 824445 - protein, 903 aa, Homo sapiens; identical to SEQ ID NO: 824442

SEQ ID NO: 824446 - protein, 503 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELCPQLCFLSCSQYTLPQIRLA

SEQ ID NO: 824447 - protein, 903 aa, Homo sapiens; identical to SEQ ID NO: 824442

SEQ ID NO: 824448 - protein, 903 aa, Homo sapiens; identical to SEQ ID NO: 824442

SEQ ID NO: 824449 - protein, 1022 aa, Homo sapiens
TGLMSVPGALGRSTSLTEKDLKEAKARSQQIAAQLTTPPSSNSRGVQLFNRRRQRVNEFTLESHGQRGQKPSQESLRVLPSSLPGHAPGLSLSSTSLPEPGPPRHPSPQSPDRGVPGHSMEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 824450 - protein, 903 aa, Homo sapiens; identical to SEQ ID NO: 824442

SEQ ID NO: 824451 - protein, 437 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSLPPSTMATCLRTGSCAQSPPSSRHTSCAPRSLSSHLSRSLPRSHQELPRPPSPAPWTWCPTCPRGLSLHLLPCLGPRAPHRASTPPPARTACSPLP

SEQ ID NO: 824452 - protein, 477 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGFVLFHKIPLDG

SEQ ID NO: 824453 - protein, 477 aa, Homo sapiens; identical to SEQ ID NO: 824452

SEQ ID NO: 824454 - protein, 477 aa, Homo sapiens; identical to SEQ ID NO: 824452

SEQ ID NO: 824455 - protein, 101 aa, Homo sapiens
GVMDVRCFLSMDPDSNAVTVMTLIFVKRVSRPFLHYTRHTFGRINEPRLQLVSNTSYKSRPTRKNKSQHTLEIIDSGVFSPSLPAGTDFISDPLGFLSRNR

SEQ ID NO: 824456 - protein, 537 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTWPRGSPKTA

SEQ ID NO: 824457 - protein, 477 aa, Homo sapiens; identical to SEQ ID NO: 824452

SEQ ID NO: 824458 - protein, 477 aa, Homo sapiens; identical to SEQ ID NO: 824452

SEQ ID NO: 824459 - protein, 822 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 824460 - protein, 472 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKALLEGIL

SEQ ID NO: 824461 - protein, 315 aa, Homo sapiens
MCWAGTGLVSPERRYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824462 - protein, 435 aa, Homo sapiens
MPPSFKSTAASTIDPAKTASSSADEDAVFGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824463 - protein, 535 aa, Homo sapiens
LNSWDYRQCTTITSEFLKIIFVETGSHYVAQTSLEVLTSAPQSARITGVSHCFCLHYLKFLEPNFTVLPRSRNCLRQQDGASGFFTRQTVLKLGSMKGKQQQLKLKLGDSFPYGNPNNFPLLCFFFFSLGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824464 - protein, 233 aa, Homo sapiens
GGHSRKIPRPKPAPLTAEIRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824465 - protein, 187 aa, Homo sapiens
DPHAITSALIRLRFVAQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824466 - protein, 178 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLVIK

SEQ ID NO: 824467 - protein, 256 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRP

SEQ ID NO: 824468 - protein, 206 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLEGDWRDYGFLMNFLLEPACLLFLSCLHYFIY

SEQ ID NO: 824469 - protein, 124 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQNLQIDFHEDICLQN

SEQ ID NO: 824470 - protein, 504 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824471 - protein, 435 aa, Homo sapiens
IPYTVVLLQLFQGARLVVDSPLARSARLPGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 824472 - protein, 504 aa, Homo sapiens; identical to SEQ ID NO: 824470

SEQ ID NO: 824473 - protein, 504 aa, Homo sapiens; identical to SEQ ID NO: 824470

SEQ ID NO: 824474 - protein, 475 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWW

SEQ ID NO: 824475 - protein, 113 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMAWQFWPFHHHLQPRL

SEQ ID NO: 824476 - protein, 158 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKLLNRASVEGLF

SEQ ID NO: 824477 - protein, 107 aa, Homo sapiens
IPYTVVLLQLFQGARLVVDSPLARSARLPGNSSPLFSAPCSMGAGPSLLLAALLLLLSGDGAVRCDTPANCTYLDLLGTWVFQVGSSGSQRDVNCSVMGKPPARQSS

SEQ ID NO: 824478 - protein, 158 aa, Homo sapiens
MAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 824479 - protein, 533 aa, Homo sapiens
GRPPSGLPPGPRSPPPLAGPGQKMVQKKPAELQGFHRSFKGQNPFELAFSLDQPDHGDSDFGLQCSARPGEGPEGEEGTGQLLSLPWQWPAPAGGWGPAGQGHVLSPLGVPPGTDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824480 - protein, 495 aa, Homo sapiens
GRPPSGLPPGPRSPPPLAGPGQKMVQKKPAELQGFHRSFKGQNPFELAFSLDQPDHGDSDFGLQCSARPGEGPEGEEGTGQLLSLPWQWPAPAGGWGPAGQGHVLSPLGVPPGTDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824481 - protein, 522 aa, Homo sapiens
GRPPSGLPPGPRSPPPLAGPGQKMVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGRWYPARSLLGPPAKDSWKTSRPSPRRGSVASPPGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824482 - protein, 470 aa, Homo sapiens
GRPPSGLPPGPRSPPPLAGPGQKMVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824483 - protein, 138 aa, Homo sapiens
KITIQRRLAWPLRKDDTQIREAFHIDGLCFPVLEEYLNVGGPGGGGLGDRLPGPAAPPESRMMVTVRWPWGCSAFPGPHCPYLWTAPSKDPWGGWGIPPTPFPHHFSPVSDSMFRNGGFSAFLYQRTSKWTPARCRRP

SEQ ID NO: 824484 - protein, 491 aa, Homo sapiens
GRPPSGLPPGPRSPPPLAGPGQKMVQKKPAELQGFHRSFKGQNPFELAFSLDQPDHGDSDFGLQCSARPGEGPEGEEGTGQLLSLPWQWPAPAGGWGPAGQGHVLSPLGVPPGTDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGVSTSRTGGRRVRPGEHLAHSHGPAEVGQSLPPPSPPLSHPRATWRTGQNRYCE

SEQ ID NO: 824485 - protein, 401 aa, Homo sapiens
GRPPSGLPPGPRSPPPLAGPGQKMVQKKPAELQGFHRSFKGQNPFELAFSLDQPDHGDSDFGLQCSARPGEGPEGEEGTGQLLSLPWQWPAPAGGWGPAGQGHVLSPLGVPPGTDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQSTSVLPSTSVLPSTSVLP

SEQ ID NO: 824486 - protein, 225 aa, Homo sapiens
GRPPSGLPPGPRSPPPLAGPGQKMVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGRW

SEQ ID NO: 824487 - protein, 437 aa, Homo sapiens
GRPPSGLPPGPRSPPPLAGPGQKMVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 824488 - protein, 488 aa, Homo sapiens
GRPPSGLPPGPRSPPPLAGPGQKMVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824489 - protein, 418 aa, Homo sapiens [sequence omitted]

SEQ ID NO: 824490 - protein, 348 aa, Homo sapiens
ALVDPPSQAFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824491 - protein, 356 aa, Homo sapiens
DAWVDPRVRGGGDAVPVPGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGVSTSRTGAGGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 824492 - protein, 488 aa, Homo sapiens; identical to SEQ ID NO: 824488

SEQ ID NO: 824493 - protein, 488 aa, Homo sapiens; identical to SEQ ID NO: 824488

SEQ ID NO: 824494 - protein, 152 aa, Homo sapiens
GRPPSGLPPGPRSPPPLAGPGQKMVQKKPAELQGFHRSFKVRPGVGLGALRAGPPEWPAWGARGPPLRSAPGARAWPPPYTRGCPGRPCAEAGSVCEDGGSAGHSPLSSHGRRVLPPGPPSEAGSRSPLRVRAPGCVSPASPRRVCSGGSAG

SEQ ID NO: 824495 - protein, 598 aa, Homo sapiens
RWRGAGSRRPASGARAGPPSPLGGAERAGGGGPRLGATEAGSRDRPPSPPPLHWEPAGMEREALPWGLEPQDVQSSDEMRSPEGYLRGNMSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPDEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRIHTGEKPYKCEVCSKAFSQSSDLIKHQRTHTGERPYKCPRCGKAFADSSYLLRHQRTHSGQKPYKCPHCGKAFGDSSYLLRHQRTHSHERPYSCTECGKCYSQNSSLRSHQRVHTGQRPFSCGICGKSFSQRSALIPHARSHAREKPFKCPECGKRFGQSSVLAIHARTHLPGRTYSCPDCGKTFNRSSTLIQHQRSHTGERPYRCAVCGKGFCRSSTLLQHHRVHSGERPYKCDDCGKAFSQSSDLIRHQRTHAAGRR

SEQ ID NO: 824496 - protein, 598 aa, Homo sapiens; identical to SEQ ID NO: 824495

SEQ ID NO: 824497 - protein, 484 aa, Homo sapiens
RWRGAGSRRPASGARAGPPSPLGGAERAGGGGPRLGATEAGSRDRPPSPPPLHWEPAGMEREALPWGLEPQDVQSSDEMRSPEGYLRGNMSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPDEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRIHTGEKPYKCEVCSKAFSQSSDLIKHQRTHTGERPYKCPRCGKAFADSSYLLRHQRTHSGQKPYKCPHCGKAFGDSSYLLRHQRTHSHERPYSCTECGKCYSQNSSLRSHQRVHTGQRPFSCGICGLASGYGHGWPAPSSGQSRL

SEQ ID NO: 824498 - protein, 378 aa, Homo sapiens
RWRGAGSRRPASGARAGPPSPLGGAERAGGGGPRLGATEAGSRDRPPSPPPLHWEPAGMEREALPWGLEPQDVQSSDEMRSPEGYLRGNMSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPDEKSPLNISVGVHPLDSFTQGFGEQPTGDLPIGPPFEMPTGALLSTPQFEMLQNPLGLTGALRGPGRRGGRARGGQGPRPNICGICGKSFGRGSTSHPAPALPHGRAALQVRRVRQGLLPLLHASAASPGPQWRAALQVR

SEQ ID NO: 824499 - protein, 598 aa, Homo sapiens; identical to SEQ ID NO: 824495

SEQ ID NO: 824500 - protein, 378 aa, Homo sapiens; identical to SEQ ID NO: 824498

SEQ ID NO: 824501 - protein, 227 aa, Homo sapiens
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGYVFCMLHRLPEQHDCTFDHMGRGREEAIMKMVKLDRKVGRSCQRIGEGCS

SEQ ID NO: 824502 - protein, 205 aa, Homo sapiens
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEEYSQSENEASPVKRPRLLENTERSEETSRSKQKSRRRCFQCQTKLELVQQELGSCRCGYVFCMLHRLPEQHDCTFDHMGRGREEAIMKMVKLDRKVGRSCQRIGEGCS

SEQ ID NO: 824503 - protein, 227 aa, Homo sapiens; identical to SEQ ID NO: 824501

SEQ ID NO: 824504 - protein, 227 aa, Homo sapiens; identical to SEQ ID NO: 824501

SEQ ID NO: 824505 - protein, 227 aa, Homo sapiens; identical to SEQ ID NO: 824501

SEQ ID NO: 824506 - protein, 191 aa, Homo sapiens
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCVCVLYVTSSAAGVAS

SEQ ID NO: 824507 - protein, 223 aa, Homo sapiens
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGKHLPQWRDGDYILNTLAQLWKFKWLKSFVLLLSTVSLLQECMRYRF

SEQ ID NO: 824508 - protein, 112 aa, Homo sapiens
MWRMAAQRGGWVCTLASAARFLYWEFFKKTFHSQQESVEVLGAAAGEAAAHGLCPFQLEPPVPPGAKRMMSWPPFSFLCSPIVQGHPVHIYHIASLVREGSIRPRDSGFGSV

SEQ ID NO: 824509 - protein, 227 aa, Homo sapiens; identical to SEQ ID NO: 824501

SEQ ID NO: 824510 - protein, 227 aa, Homo sapiens; identical to SEQ ID NO: 824501

SEQ ID NO: 824511 - protein, 187 aa, Homo sapiens
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGVSLERDVWHL

SEQ ID NO: 824512 - protein, 675 aa, Homo sapiens
RLVLARGYGIWGWAEARWRIQCLESWRGGGGEGLVAGGGAGTRCDAKNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 824513 - protein, 440 aa, Homo sapiens [sequence omitted]

SEQ ID NO: 824514 - protein, 746 aa, Homo sapiens
QREGRREGIRQLQFSSLGAPTPRCPASCPQPGHAPPTLPAPQNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGERGLGPGRGSRIVNPFSFCFHDPSLSVSCLQATASRSSSTKIVGIPEFPGAVLGGSPNPMLPGPAPSDPMSFVLQGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 824515 - protein, 670 aa, Homo sapiens
QREGRREGIRQLQFSSLGAPTPRCPASCPQPGHAPPTLPAPQNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 824516 - protein, 634 aa, Homo sapiens
QREGRREGIRQLQFSSLGAPTPRCPASCPQPGHAPPTLPAPQNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHGE

SEQ ID NO: 824517 - protein, 670 aa, Homo sapiens; identical to SEQ ID NO: 824515

SEQ ID NO: 824518 - protein, 634 aa, Homo sapiens; identical to SEQ ID NO: 824516

SEQ ID NO: 824519 - protein, 399 aa, Homo sapiens
QREGRREGIRQLQFSSLGAPTPRCPASCPQPGHAPPTLPAPQNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLCKCHLYIPLWELGGTVSWWALWPQGVPDSHHLTPRNSSSTE

SEQ ID NO: 824520 - protein, 243 aa, Homo sapiens
QREGRREGIRQLQFSSLGAPTPRCPASCPQPGHAPPTLPAPQNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRGTGPWDGVEPHTLSRQKVKATSDLSSCPLGFVAKELEAQ

SEQ ID NO: 824521 - protein, 670 aa, Homo sapiens; identical to SEQ ID NO: 824515

SEQ ID NO: 824522 - protein, 591 aa, Homo sapiens
MGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 824523 - protein, 440 aa, Homo sapiens [sequence omitted]

SEQ ID NO: 824524 - protein, 670 aa, Homo sapiens; identical to SEQ ID NO: 824515

SEQ ID NO: 824525 - protein, 391 aa, Homo sapiens
QREGRREGIRQLQFSSLGAPTPRCPASCPQPGHAPPTLPAPQNPRHPPEPPQSWPRRMGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSWTQRVWAAWALAMRADTLPWRRWHPEHTGYG

SEQ ID NO: 824526 - protein, 670 aa, Homo sapiens; identical to SEQ ID NO: 824515

SEQ ID NO: 824527 - protein, 670 aa, Homo sapiens; identical to SEQ ID NO: 824515

SEQ ID NO: 824528 - protein, 142 aa, Homo sapiens
GRSNIRGGPSHWCHCPWYHHLLLHEEASKTVIPYSPGLAGVDCLSSVPAQLVGGVGQDGVAELGVRPGGGPVSVELVGPRSHRLRLHSLGPEDEGVYHCAPSAWVQHADYSWYQAGSARSGPVTVYPYMHGLDTLSLCPLFL

SEQ ID NO: 824529 - protein, 4356 aa, Homo sapiens
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEETKM

SEQ ID NO: 824530 - protein, 4356 aa, Homo sapiens
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKC

SEQ ID NO: 824531 - protein, 4356 aa, Homo sapiens; identical to SEQ ID NO: 824529

SEQ ID NO: 824532 - protein, 439 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 824533 - protein, 439 aa, Homo sapiens; identical to SEQ ID NO: 824532

SEQ ID NO: 824534 - protein, 405 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGIGMLGRCVYDFEIMDFWPSQPMATLSGLRLRW

SEQ ID NO: 824535 - protein, 439 aa, Homo sapiens; identical to SEQ ID NO: 824532

SEQ ID NO: 824536 - protein, 439 aa, Homo sapiens; identical to SEQ ID NO: 824532

SEQ ID NO: 824537 - protein, 439 aa, Homo sapiens; identical to SEQ ID NO: 824532

SEQ ID NO: 824538 - protein, 439 aa, Homo sapiens; identical to SEQ ID NO: 824532

SEQ ID NO: 824539 - protein, 421 aa, Homo sapiens
MFSKLAHLQRFAVLSRGVHSSVASATSVATKKTVQGPPTSDDIFEREYKYGAHNYHPLPVALERGKGIYLWDVEGRPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 824540 - protein, 437 aa, Homo sapiens
KARPGGPAAPASQPGRARSRAHLRGSAHRGAQNVQALHLDDIRPGSLYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 824541 - protein, 239 aa, Homo sapiens
MPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 824542 - protein, 180 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFADCVQSLS

SEQ ID NO: 824543 - protein, 439 aa, Homo sapiens; identical to SEQ ID NO: 824532

SEQ ID NO: 824544 - protein, 439 aa, Homo sapiens; identical to SEQ ID NO: 824532

SEQ ID NO: 824545 - protein, 439 aa, Homo sapiens; identical to SEQ ID NO: 824532

SEQ ID NO: 824546 - protein, 438 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIETSWRQVVL

SEQ ID NO: 824547 - protein, 439 aa, Homo sapiens; identical to SEQ ID NO: 824532

SEQ ID NO: 824548 - protein, 439 aa, Homo sapiens; identical to SEQ ID NO: 824532

SEQ ID NO: 824549 - protein, 301 aa, Homo sapiens
MNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 824550 - protein, 129 aa, Homo sapiens [sequence omitted]

SEQ ID NO: 824551 - protein, 158 aa, Homo sapiens
MAAQGVGPGPGSAAPPGLEAARQKLALRRKKVLSTEEMELYELAQAAGGGIDPDVFKILVDLLKLNVAPLAVFQMLKSMCAGQRLASEPQDPAAVSLPTSSVPETRGRDKGSAALGGVLALAERSNHEGSSQRMPRQPSATRLPKGGGPGKSPTQGST

SEQ ID NO: 824552 - protein, 158 aa, Homo sapiens; identical to SEQ ID NO: 824551

SEQ ID NO: 824553 - protein, 158 aa, Homo sapiens; identical to SEQ ID NO: 824551

SEQ ID NO: 824554 - protein, 213 aa, Homo sapiens
MAAQGVGPGPGSAAPPGLEAARQKLALRRKKVLSTEEMELYELAQAAGGGIDPDVFKILVDLLKLNVAPLAVFQMLKSMCAGQRLASEPQDPAAVSLPTSSVPETRGLSDNFEDKAAPQQDFTQQLRGPEKQHRMVWQEKEDMHKQLVEASETLKSQAKELKDAHQQQKLALQEFLELNELMAELYSQKQKVWDKEEEMEVAMQKADMMWQEI

SEQ ID NO: 824555 - protein, 158 aa, Homo sapiens; identical to SEQ ID NO: 824551

SEQ ID NO: 824556 - protein, 158 aa, Homo sapiens; identical to SEQ ID NO: 824551

SEQ ID NO: 824557 - protein, 274 aa, Homo sapiens
MAAQGVGPGPGSAAPPGLEAARQKLALRRKKVLSTEEMELYELAQAAGGGIDPDVFKLSGAGGGRMLARHPRPLLSGYARPAGREEPPLPPPPSLSGLQGGGRAGRRGLTGPASVPARILVDLLKLNVAPLAVFQMLKSMCAGQRLASEPQDPAAVSLPTSSVPETRGLSDNFEDKAAPQQDFTQQLRGPEKQHRMVWQEKEDMHKQLVEASETLKSQAKELKDAHQQQKLALQEFLELNELMAELYSQKQKVWDKEEEMEVAMQKADMMWQEI

SEQ ID NO: 824558 - protein, 103 aa, Homo sapiens
MWRTAATSWRRRRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 824559 - protein, 252 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDANGDLRG

SEQ ID NO: 824560 - protein, 252 aa, Homo sapiens; identical to SEQ ID NO: 824559

SEQ ID NO: 824561 - protein, 252 aa, Homo sapiens; identical to SEQ ID NO: 824559

SEQ ID NO: 824562 - protein, 252 aa, Homo sapiens; identical to SEQ ID NO: 824559

SEQ ID NO: 824563 - protein, 290 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDVNTLLPSLPPLPARCLLPFLALFLRLPCHSSAKKAACAQLGVMTP

SEQ ID NO: 824564 - protein, 252 aa, Homo sapiens; identical to SEQ ID NO: 824559

SEQ ID NO: 824565 - protein, 290 aa, Homo sapiens; identical to SEQ ID NO: 824563

SEQ ID NO: 824566 - protein, 149 aa, Homo sapiens
MPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTQGLGYHICVR

SEQ ID NO: 824567 - protein, 252 aa, Homo sapiens; identical to SEQ ID NO: 824559

SEQ ID NO: 824568 - protein, 252 aa, Homo sapiens; identical to SEQ ID NO: 824559

SEQ ID NO: 824569 - protein, 252 aa, Homo sapiens; identical to SEQ ID NO: 824559

SEQ ID NO: 824570 - protein, 249 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDALSH

SEQ ID NO: 824571 - protein, 151 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVSQGKET

SEQ ID NO: 824572 - protein, 124 aa, Homo sapiens
SAITTEMASQSQGIQQLLQAEKRAAEKVADARKRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 824573 - protein, 290 aa, Homo sapiens
MVSSAPLCSFCSLLPMGSSHIGGLSINERRCSASLGLVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDANGDLRG

SEQ ID NO: 824574 - protein, 252 aa, Homo sapiens; identical to SEQ ID NO: 824559

SEQ ID NO: 824575 - protein, 290 aa, Homo sapiens; identical to SEQ ID NO: 824563

SEQ ID NO: 824576 - protein, 290 aa, Homo sapiens; identical to SEQ ID NO: 824563

SEQ ID NO: 824577 - protein, 149 aa, Homo sapiens; identical to SEQ ID NO: 824566

SEQ ID NO: 824578 - protein, 252 aa, Homo sapiens; identical to SEQ ID NO: 824559

SEQ ID NO: 824579 - protein, 252 aa, Homo sapiens; identical to SEQ ID NO: 824559

SEQ ID NO: 824580 - protein, 105 aa, Homo sapiens
SAITTEMASQSQGIQQLLQAEKRAAEKVADARKRKARRLKQAKEEAQMEVEQYRREREHEFQSKQQATGIFQRQAWSARICITAEGPVSGPLRLRSCSQEGGRLE

SEQ ID NO: 824581 - protein, 311 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKCCNKRVWSIKNAMNEGACRKNGTRISGRGEDSKGRKSVSPRSSETRSRQAAKNNKTRKRPDLCHRTAEPALDQWDEGMCTKGTIKSDKRTTPDRRERRGHGKCTRCKTRGKQRKQAVKDGRARDHWQGTANERTLSGAVTGEAKTASQHTGRRRQRRGRHSERHTKR

SEQ ID NO: 824582 - protein, 275 aa, Homo sapiens
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 824583 - protein, 317 aa, Homo sapiens
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDGGSGDSGGGARVLATAQPLGSLWAPGGGCPAPPEAAPSSPPAERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 824584 - protein, 275 aa, Homo sapiens; identical to SEQ ID NO: 824582

SEQ ID NO: 824585 - protein, 211 aa, Homo sapiens
MLLLAPQMLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENNICDAERDISGDLRVDQQN

SEQ ID NO: 824586 - protein, 275 aa, Homo sapiens; identical to SEQ ID NO: 824582

SEQ ID NO: 824587 - protein, 266 aa, Homo sapiens
MLNLLLLALPVLASRAYAAPAPGQALQRVGIVGGQEAPRSKWPWQVSLRVHGPYWMHFCGGSLIHPQWVLTAAHCVGPVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 824588 - protein, 266 aa, Homo sapiens; identical to SEQ ID NO: 824587

SEQ ID NO: 824589 - protein, 523 aa, Homo sapiens
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 824590 - protein, 657 aa, Homo sapiens
RAQPPGQSSPAEAQPQAPSPVRRGGPPVSPALRPARPRHLRTAGGETWPLPGPRVGPAWRQALASRSSHGSVPSCLSLGTPGPCPLSGGSRLSPIRVLEAKQPPAWPFQAWWLHPTRGMRASLETVSSAERRHISLRMGKRWPGAAQCPSRTAGVVVAVAAGQGLLARGRCLKPLCLVFSLLIYLWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 824591 - protein, 274 aa, Homo sapiens
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGK

SEQ ID NO: 824592 - protein, 176 aa, Homo sapiens
VCLPVPLLPWVFLSCRPVHTLPGFLPAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 824593 - protein, 388 aa, Homo sapiens
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKYVWPSHSFLPTVGTRDPSRPAMQGRPRAPGPGTAREPSTFIAPSPSARRTELAI

SEQ ID NO: 824594 - protein, 41 aa, Homo sapiens
DPGGEGSPGTPPVLQPHAQSLCPALCLQGERATGFGVALLL

SEQ ID NO: 824595 - protein, 523 aa, Homo sapiens; identical to SEQ ID NO: 824589

SEQ ID NO: 824596 - protein, 324 aa, Homo sapiens
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKMSAEQKHFGHSNSKCSHGMREVKERRFRVFVLTIPHSRVLFWVLCFDTGR

SEQ ID NO: 824597 - protein, 324 aa, Homo sapiens; identical to SEQ ID NO: 824596

SEQ ID NO: 824598 - protein, 373 aa, Homo sapiens
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVRAPAWLTARLLLQPGLPAHPASPAL

SEQ ID NO: 824599 - protein, 562 aa, Homo sapiens
CWHEGESNPEQGPIRAWTGGRMFSWMGRQAGGRERAGGADAVQTVTGGLRSLYLRKVLPLEEAYRFHEFHSPALEDADFENKPMILLVGQYSTGKTTFIRYLLEQDFPGMRIGPEPTTDSFIAVMYGETEGSTPGNALVVDPKKPFRKLSRFGNAFLNRFMCSQLPNQVLKSISVIDSPGILSGEKQRISRGYDFCQVLQWFAERVDRIILLFDAHKLDISDEFSEAIKAFRGQDDKIRVVLNKADQVDTQQLMRVYGALMWSLGKVINTPEVLRVYIGSFWAQPLQNTDNRRLFEAEAQDLFRDIQSLPQKAAVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTTEGPFNQGYGEGAKEGADEEEWVVAKDKPVYDELFYTLSPINGKISGVNAKKEMVTSKLPNSVLGKIWKLADCDCDGMLDEEEFALAKHLIKIKLDGYELPSSLPPHLVPPSHRKSLPKAD

SEQ ID NO: 824600 - protein, 562 aa, Homo sapiens; identical to SEQ ID NO: 824599

SEQ ID NO: 824601 - protein, 101 aa, Homo sapiens
MCQNPGPFLPPYCRLVPLLPRKVLISPGAFNICCGLVSHCCSPPPELWGLPLPEGPPDARLFPPARRRCGLRRGPRGLGFCNSPSPLLGAALVCPKNRGYP

SEQ ID NO: 824602 - protein, 562 aa, Homo sapiens; identical to SEQ ID NO: 824599

SEQ ID NO: 824603 - protein, 562 aa, Homo sapiens; identical to SEQ ID NO: 824599

SEQ ID NO: 824604 - protein, 562 aa, Homo sapiens; identical to SEQ ID NO: 824599

SEQ ID NO: 824605 - protein, 128 aa, Homo sapiens
CWHEGESNPEQGPIRAWTGGRMFSWMGRQAGGRERAGGADAVQTVTGGLRSLYLRKVLPLEEAYRFHEFHSPALEDADFENKPLLHSVAHQWQDIRCQRQEGDGDLQAAQQRPGQDLEAGRLRLRRHA

SEQ ID NO: 824606 - protein, 562 aa, Homo sapiens; identical to SEQ ID NO: 824599

SEQ ID NO: 824607 - protein, 292 aa, Homo sapiens
CWHEGESNPEQGPIRAWTGGRMFSWMGRQAGGRERAGGADAVQTVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTTEGPFNQGYGEGAKEGADEEEWVVAKDKPVYDELFYTLSPINGKISGVNAKKEMVTSKLPNSVLGKIWKLADCDCDGMLDEEEFALAKHLIKIKLDGYELPSSLPPHLVPPSHRKSLPKAD

SEQ ID NO: 824608 - protein, 562 aa, Homo sapiens; identical to SEQ ID NO: 824599

SEQ ID NO: 824609 - protein, 562 aa, Homo sapiens; identical to SEQ ID NO: 824599

SEQ ID NO: 824610 - protein, 450 aa, Homo sapiens
MPSIDYFIDSDCIDILDCADTPGNAYFLIGKTLPGKLSRFGNAFLNRFMCSQLPNQVLKSISVIDSPGILSGEKQRISRGYDFCQVLQWFAERVDRIILLFDAHKLDISDEFSEAIKAFRGQDDKIRVVLNKADQVDTQQLMRVYGALMWSLGKVINTPEVLRVYIGSFWAQPLQNTDNRRLFEAEAQDLFRDIQSLPQKAAVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTTEGPFNQGYGEGAKEGADEEEWVVAKDKPVYDELFYTLSPINGKISGVNAKKEMVTSKLPNSVLGKIWKLADCDCDGMLDEEEFALAKHLIKIKLDGYELPSSLPPHLVPPSHRKSLPKAD

SEQ ID NO: 824611 - protein, 236 aa, Homo sapiens
CWHEGESNPEQGPIRAWTGGRMFSWMGRQAGGRERAGGADAVQTVTGGLRSLYLRKVLPLEEAYRFHEFHSPALEDADFENKPMILLVGQYSTGKTTFIRYLLEQDFPGMRIGPEPTTDSFIAVMYGETEGSTPGNALVVDPKKPFRKLSRFGNAFLNRFMCSQLPNQVLKSISVIDSPGILSGEKQRISRGYDFCQVLQWFAERVDRIILLFDAHKLVSPPNLPSRGLTSKAIFG

SEQ ID NO: 824612 - protein, 493 aa, Homo sapiens
CWHEGESNPEQGPIRAWTGGRMFSWMGRQAGGRERAGGADAVQTVTGGLRSLYLRKVLPLEEAYRFHEFHSPALEDADFENKPMILLVGQYSTGKTTFIRYLLEQDFPGMRIGPEPTTDSFIAVMYGETEGSTPGNALVVDPKKPFRKLSRFGNAFLNRFMCSQLPNQVLKSISVIDSPGILSGEKQRISRGYDFCQVLQWFAERVDRIILLFDAHKLDISDEFSEAIKAFRGQDDKIRVVLNKADQVDTQQLMRVYGALMWSLGKVINTPEVLRVYIGSFWAQPLQNTDNRRLFEAEAQDLFRDIQSLPQKAAVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTTEGPFNQGYGEGAKEGADEEEWVVAKDKPVYDELFYTLSPINGKISGVNAKG

SEQ ID NO: 824613 - protein, 760 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 824614 - protein, 89 aa, Homo sapiens
AGDGGGSGRGGGGVSVRVAWGRGGEAAAAVSKLRHSGWGVGSGSAERGRGGGGEKSEAEEGVPWPGSSSSTMTVGTPSSTSSPPSWGSS

SEQ ID NO: 824615 - protein, 89 aa, Homo sapiens; identical to SEQ ID NO: 824614

SEQ ID NO: 824616 - protein, 760 aa, Homo sapiens; identical to SEQ ID NO: 824613

SEQ ID NO: 824617 - protein, 760 aa, Homo sapiens; identical to SEQ ID NO: 824613

SEQ ID NO: 824618 - protein, 727 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 824619 - protein, 689 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVWKFMRLSLCQKITHSGIQQ

SEQ ID NO: 824620 - protein, 520 aa, Homo sapiens [sequence omitted]

SEQ ID NO: 824621 - protein, 127 aa, Homo sapiens
PLFFFFFFFCFQEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 824622 - protein, 545 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGVKTWVSEPIFPSERNILFTFPIDLYCSGRVIQFSYFHLKITTTFN

SEQ ID NO: 824623 - protein, 215 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVVSFSFLS

SEQ ID NO: 824624 - protein, 760 aa, Homo sapiens; identical to SEQ ID NO: 824613

SEQ ID NO: 824625 - protein, 760 aa, Homo sapiens; identical to SEQ ID NO: 824613

SEQ ID NO: 824626 - protein, 620 aa, Homo sapiens
MFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 824627 - protein, 760 aa, Homo sapiens; identical to SEQ ID NO: 824613

SEQ ID NO: 824628 - protein, 262 aa, Homo sapiens
ATGEEKKEKDRKKKKFQKSRSKHKKHKSSSSSSSSSSSSSSTETSESSSESESNNKEKKIQRKKRKKNKCSGHKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 824629 - protein, 767 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKDVLIDDRPVTSLSRCARSTLEASGIARRGQQHQEDSKGLDDSMKENEKGEYEEV

SEQ ID NO: 824630 - protein, 520 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRSRAEDQRLRGRE

SEQ ID NO: 824631 - protein, 95 aa, Homo sapiens
ILNEINPPPPFAAAAAAMSMLRLQKRLASSVLRCGKKKVWLDPNETNEIANANSRQQIRKLIKDGLIIRKPVTVHSRARCRKNTLARRKGHGTWA

SEQ ID NO: 824632 - protein, 95 aa, Homo sapiens; identical to SEQ ID NO: 824631

SEQ ID NO: 824633 - protein, 98 aa, Homo sapiens
RILNKLIPPPRFPFAAAAAAMSMLRLQKRLASSVLRCGKKKVWLDPNETNEIANANSRQQIRKLIKDGLIIRKPVTVHSRARCRKNTLARRKGHGTWA

SEQ ID NO: 824634 - protein, 112 aa, Homo sapiens
RTLEPSGCILRGSFATCITACTLKVNGECVQKQADSHGTHPQAEGRQGPAKKLPGLTRLRPCRSKTKECTQGAVKSAFQAKERREIIKTLFQGEEETTEIKPPTLSVHTWPL

SEQ ID NO: 824635 - protein, 97 aa, Homo sapiens
GRLLLLLLLEFKLLTMYGEDSHGTHPQAEGRQGPAKKLPGLTRLRPCRSKTKECTQGAVKSAFQANERREIIKTLFQGEEETTEIKPPTLSVHTWPL

SEQ ID NO: 824636 - protein, 107 aa, Homo sapiens
KYPVPLPSSRGLHGNCEEGRFSVVGDSAAMSMLRLQKRLASSVLRCGKKKVWLDPNETNEIANANSRQQIRKLIKDGLIIRKPVTVHSRARCRKNTLARRKGHGTWA

SEQ ID NO: 824637 - protein, 73 aa, Homo sapiens
RSSSAHVQIGPQEAPGLTRLRPCRSKTKECTQGAVKSAFQAKERREIIKTLFQGEEETTEIKPPTLSVHTWPL

SEQ ID NO: 824638 - protein, 107 aa, Homo sapiens; identical to SEQ ID NO: 824636

SEQ ID NO: 824639 - protein, 102 aa, Homo sapiens
MERTDLCITACTLKVNGECVQKQADSHGTHPQAEGRQGPAKKLPGLTRLRPCRSKTKECTQGAVKSAFQAKERREIIKTLFQGEEETTEIKPPTLSVHTWPL

SEQ ID NO: 824640 - protein, 173 aa, Homo sapiens
MPADYGSSWLHGDLMTHSQMFGLHQSLVTGQELSQEESSYLQKMAGLCSKILEASTVIHLWGPAKGSKGHPYLRGKEGPQEAPGLTRLRPCRSKTKECTQGAVKSAFQAKERREIIKTLFQGEEETGLAIVAQAELTTPESQDDPPHLQPLKIAGITALVLPRSHVAPLKHHM

SEQ ID NO: 824641 - protein, 125 aa, Homo sapiens
AGGLALRCCCRCRDVVLMVVSIRRTSLVIGVPHAMVGNRSNGSGLAPHYMIADDRYVTLATSFRLGHALRVTAASIHVLRCIAVTGNATVARDRTCRVDCAVRSDHEHALCPRHGKMVRGSAADE

SEQ ID NO: 824642 - protein, 86 aa, Homo sapiens
SNHVFCVCMSMLRLQKRLASSVLRCGKKKVWLDPNETNEIANANSRQQIRKLIKDGLIIRKPVTVHSRARCRKNTLARRKGHGTWA

SEQ ID NO: 824643 - protein, 67 aa, Homo sapiens
VTRPTIRLDYDLARGLTEIHQCQLPSADPEAHQRWADHPQACDGPFPGSMPEKHLGPPEGARHMGIG

SEQ ID NO: 824644 - protein, 100 aa, Homo sapiens
SRPGEVVTKKKKKKKKKKAAAAMSMLRLQKRLASSVLRCGKKKVWLDPNETNEIANANSRQQIRKLIKDGLIIRKPVTVHSRARCRKNTLARRKGHGTWA

SEQ ID NO: 824645 - protein, 91 aa, Homo sapiens
PPFLKPFAAAAAAMSMLRLQKRLASSVLRCGKKKVWLDPNETNEIANANSRQQIRKLIKDGLIIRKPVTVHSRARCRKNTLARRKGHGTWA

SEQ ID NO: 824646 - protein, 134 aa, Homo sapiens
NPVNEASYDGKSFLLIGHSESGYNEYVSCSTISSDEFANTMPVRPPTVKTLDPLSGSVMLRLQKRLASSVLRCGKKKVWLDPNETNEIANANSRQQIRKLIKDGLIIRKPVTVHSRARCRKNTLARRKGQGTWA

SEQ ID NO: 824647 - protein, 76 aa, Homo sapiens
SLVSLGSNQTFFLPTPEDTRGEPLLKPEHTHGCGRSQQIRKLIKDGLIIRKPVTVHSRARCRKNTLARRKGHGTWA

SEQ ID NO: 824648 - protein, 135 aa, Homo sapiens
MAKDRGDFIASWAFHIHEVGIGALHQAFLLVFPVLLFWRGMKEILCQRHVLVCVGRSCRIRQSFAAAAAAMSMLRLQKRLASSVLRCGKKKVWLDPNETNEIANANSRQQIRKLIKDGLIIRKPVTVHSRARCRR

SEQ ID NO: 824649 - protein, 95 aa, Homo sapiens; identical to SEQ ID NO: 824631

SEQ ID NO: 824650 - protein, 98 aa, Homo sapiens; identical to SEQ ID NO: 824633

SEQ ID NO: 824651 - protein, 98 aa, Homo sapiens; identical to SEQ ID NO: 824633

SEQ ID NO: 824652 - protein, 90 aa, Homo sapiens
SRGWVCIGRGAAMSMLRLQKRLASSVLRCGKKKVWLDPNETNEIANANSRQQIRKLIKDGLIIRKPVTVHSRARCRKNTLARRKGHGTWA

SEQ ID NO: 824653 - protein, 90 aa, Homo sapiens; identical to SEQ ID NO: 824652

SEQ ID NO: 824654 - protein, 98 aa, Homo sapiens; identical to SEQ ID NO: 824633

SEQ ID NO: 824655 - protein, 98 aa, Homo sapiens; identical to SEQ ID NO: 824633

SEQ ID NO: 824656 - protein, 98 aa, Homo sapiens; identical to SEQ ID NO: 824633

SEQ ID NO: 824657 - protein, 98 aa, Homo sapiens; identical to SEQ ID NO: 824633

SEQ ID NO: 824658 - protein, 110 aa, Homo sapiens
SVPRRLGLRRSIATCITACTLKVNGECVQKQADSHGTHPQAEGRQGPAKKLPGLTRLRPCRSKTKECTQGAVKSAFQAKERREIIKTLFQGEEETTEIKPPTLSVHTWPL

SEQ ID NO: 824659 - protein, 95 aa, Homo sapiens; identical to SEQ ID NO: 824631

SEQ ID NO: 824660 - protein, 95 aa, Homo sapiens; identical to SEQ ID NO: 824631

SEQ ID NO: 824661 - protein, 97 aa, Homo sapiens; identical to SEQ ID NO: 824635

SEQ ID NO: 824662 - protein, 31 aa, Homo sapiens
MILHTYSLQDSWDYSAGITSKSRCSIKTSYA

SEQ ID NO: 824663 - protein, 98 aa, Homo sapiens; identical to SEQ ID NO: 824633

SEQ ID NO: 824664 - protein, 94 aa, Homo sapiens
VSVVRAGWCNSAEAQPGGMLRLQKRLASSVLRCGKKKVWLDPNETNEIANANSRQQIRKLIKDGLIIRKPVTVHSRARCRKNTLARRKGQGTWA

SEQ ID NO: 824665 - protein, 90 aa, Homo sapiens; identical to SEQ ID NO: 824652

SEQ ID NO: 824666 - protein, 88 aa, Homo sapiens
LAEMRAEPAAMSMLRLQKRLASSVLRCGKKKVWLDPNETNEIANANSRQQIRKLIKDGLIIRKPVTVHSRARCRKNTLARRKGHGTWA

SEQ ID NO: 824667 - protein, 99 aa, Homo sapiens
AAAYYYYIRGRVDGECVQKQADSHGTHPQAEGRQGPAKKLPGLTRLRPCRSKTKECTQGAVKSAFQAKERREIIKTLFQGEEETTEIKPPTLSVHTWPL

SEQ ID NO: 824668 - protein, 96 aa, Homo sapiens
SGLTYRSPQWQSPCVSRVPKQDQPASCPSRLLRQPRWVCYVLTCSIHMQIANANSRQQIRKLIKDGLIIRKPVTVHSRARCRKNTLARRKGHGTWA

SEQ ID NO: 824669 - protein, 85 aa, Homo sapiens
CSARFPQLSLAEPALLASLPNTALEAPGLTRLRPCRSKTKECTQGAVKSAFQAKERREIIKTLFQGEEETTEIKPPTLSVHTWPL

SEQ ID NO: 824670 - protein, 101 aa, Homo sapiens
RAAGNSARGLFGILKCNKNFPITHLAEKEMVVTGISKHFYLELLFNEHCSLQLYKPKVVTGISTPRIRHEDHQDFIQGGRDQEIKPPSWPGGALHGACVLP

SEQ ID NO: 824671 - protein, 124 aa, Homo sapiens
GTTSLFIGTSVVSRERKHRLKVGSEVRFGVHSIVAIHRHLAIHRHPDSHGTHPQAEGRQGPAKKLPGLTRLRPCRSKTKECTQGAVKSAFQAKERREIIKTLFQGEEETTEIKPPTLSVHTWPL

SEQ ID NO: 824672 - protein, 86 aa, Homo sapiens
GRVGRPTRPAMLRLQKRLASSVLRCGKKKVWLDPNETNEIANANSRQQIRKLIKDGLIIRKPVTVHSRARCRKNTLARRKGHGTWA

SEQ ID NO: 824673 - protein, 85 aa, Homo sapiens
RPARDDRDSHGTHPQAEGRQGPAKKLPGLTRLRPCRSKTKECTQGAVKSAFQAKERREIIKTLFQGEEETTEIKPPTLSVHTWPL

SEQ ID NO: 824674 - protein, 148 aa, Homo sapiens
MAKDRGDFIASWAFHIHEVGIGALHQAFLLVFPVLLFWRGMKEILCQRHVLVCVGRSCRIRQSFAAAAAAMSMLRLQKRLASSVLRCGKKKVWLDPNETNEIANANSRQQIRKLIKDGLIIRKPVTVHSRARCRKNTLARRKGHGTWA

SEQ ID NO: 824675 - protein, 107 aa, Homo sapiens; identical to SEQ ID NO: 824636

SEQ ID NO: 824676 - protein, 96 aa, Homo sapiens; identical to SEQ ID NO: 824668

SEQ ID NO: 824677 - protein, 95 aa, Homo sapiens; identical to SEQ ID NO: 824631

SEQ ID NO: 824678 - protein, 98 aa, Homo sapiens; identical to SEQ ID NO: 824633

SEQ ID NO: 824679 - protein, 98 aa, Homo sapiens; identical to SEQ ID NO: 824633

SEQ ID NO: 824680 - protein, 98 aa, Homo sapiens; identical to SEQ ID NO: 824633

SEQ ID NO: 824681 - protein, 90 aa, Homo sapiens; identical to SEQ ID NO: 824652

SEQ ID NO: 824682 - protein, 98 aa, Homo sapiens; identical to SEQ ID NO: 824633

SEQ ID NO: 824683 - protein, 98 aa, Homo sapiens; identical to SEQ ID NO: 824633

SEQ ID NO: 824684 - protein, 98 aa, Homo sapiens; identical to SEQ ID NO: 824633

SEQ ID NO: 824685 - protein, 95 aa, Homo sapiens; identical to SEQ ID NO: 824631

SEQ ID NO: 824686 - protein, 148 aa, Homo sapiens; identical to SEQ ID NO: 824674

SEQ ID NO: 824687 - protein, 73 aa, Homo sapiens; identical to SEQ ID NO: 824637

SEQ ID NO: 824688 - protein, 586 aa, Homo sapiens
PLHCLWHLGQPRPRSFPPGADGCCARGSPVPRVPRGPREREWDPAPRQNPGAAPGTPAERATPAHVPFRPSRPESPWPDLTMSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824689 - protein, 256 aa, Homo sapiens
PLHCLWHLGQPRPRSFPPGADGCCARGSPVPRVPRGPREREWDPAPRQNPGAAPGTPAERATPAHVPFRPSRPESPWPDLTMSYPGYPPPPGGYPPAAPGGGPWGGAAYPPPPSMPPIGLDNVATYAGQFNQDYLSGMAGQTLSRDGLEGGQTVPRPCIPGGPCGAWLTLAYLPPVAWLLAHVPTVMVRKLCPSIRPLVGIGNPMRRKAMGKAASPCPRELAPSNKYLPISPNWGPSLGEPWGLIDPMPMPTLVQM

SEQ ID NO: 824690 - protein, 505 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824691 - protein, 505 aa, Homo sapiens; identical to SEQ ID NO: 824690

SEQ ID NO: 824692 - protein, 505 aa, Homo sapiens; identical to SEQ ID NO: 824690

SEQ ID NO: 824693 - protein, 505 aa, Homo sapiens; identical to SEQ ID NO: 824690

SEQ ID NO: 824694 - protein, 505 aa, Homo sapiens; identical to SEQ ID NO: 824690

SEQ ID NO: 824695 - protein, 558 aa, Homo sapiens
VNWSATSRADAAVSSAGSQLWWWLPFQEAGSHGPAGALRQSLNVLSSSLPDLTMSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824696 - protein, 401 aa, Homo sapiens
MYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824697 - protein, 544 aa, Homo sapiens
MCSLSAGSEDLKSAGFISYQPRMTGVPVISSNLKEDWGLHQSQDRLSSDSFTDSSDFSIFDLNQLPNPSLKESRIYYHCLLERLPQEVNDGLLIRPEASHGPSAGPSGIIRQGVKDRETSVVVAIGFQTGLRGTSGVTVPDPGYPGQLGTAAPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824698 - protein, 373 aa, Homo sapiens [sequence omitted]

SEQ ID NO: 824699 - protein, 342 aa, Homo sapiens
CIRTRTRPSPSPSGPFGKEDEAGLFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824700 - protein, 336 aa, Homo sapiens
KGRGSDECKDKANFVLDKFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824701 - protein, 505 aa, Homo sapiens; identical to SEQ ID NO: 824690

SEQ ID NO: 824702 - protein, 505 aa, Homo sapiens; identical to SEQ ID NO: 824690

SEQ ID NO: 824703 - protein, 297 aa, Homo sapiens
PCTASGTWGSRARGVFRPALTAAAPAAPQCPECPAGPASGSGTQPLGRTQAPRPGRPRREPLPPTSHFAPRVRSPRGQGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824704 - protein, 161 aa, Homo sapiens
GRVGRPTRPMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824705 - protein, 464 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGDTSGDYRKILLKICGGND

SEQ ID NO: 824706 - protein, 505 aa, Homo sapiens; identical to SEQ ID NO: 824690

SEQ ID NO: 824707 - protein, 415 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGREILQGITGRFC

SEQ ID NO: 824708 - protein, 542 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISVRACCRPTGLPFGISVTCGTSLLGVAICLASVLCVGILIMDLGLVHPLALKQIINF

SEQ ID NO: 824709 - protein, 349 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAGARKRPKECLFLTNPQIAPRFTVLELRPVFHPS

SEQ ID NO: 824710 - protein, 284 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKASCGVGARDSEACPGLSTALLSPAFPWVGPDLPDGQ

SEQ ID NO: 824711 - protein, 106 aa, Homo sapiens
QQICVPPHNLTGRGHCQGIRVQRDFVRAGVSPGTCPGCSSSLTDRSANHLLLLISSLYCRNRVMLPHLPWFFTLHQMNLLRALFASRNDDSIPYQVPLPDEPEVGE

SEQ ID NO: 824712 - protein, 231 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQSWKRGHHLFSRALTPSKFRGLGSAKASTDKQAHLRRGAPKGRGL

SEQ ID NO: 824713 - protein, 505 aa, Homo sapiens; identical to SEQ ID NO: 824690

SEQ ID NO: 824714 - protein, 505 aa, Homo sapiens; identical to SEQ ID NO: 824690

SEQ ID NO: 824715 - protein, 508 aa, Homo sapiens
AGCTGRKVYDPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824716 - protein, 389 aa, Homo sapiens
MPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824717 - protein, 455 aa, Homo sapiens
MSYPGYPPPPGGYPPAAPGGGPWGGAAYPPPPSMPPIGLDNVATYAGQFNQDYLSGMAANMSGTFGGANMPNLYPAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824718 - protein, 336 aa, Homo sapiens
QRATRDKCTHPKNRWLRTFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824719 - protein, 236 aa, Homo sapiens
MKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824720 - protein, 505 aa, Homo sapiens; identical to SEQ ID NO: 824690

SEQ ID NO: 824721 - protein, 203 aa, Homo sapiens
MCSLLRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 824722 - protein, 515 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISSISCMPASYGHLEEATCLALKLLRVEGND

SEQ ID NO: 824723 - protein, 129 aa, Homo sapiens
HEVFFLKRSEFGSNKARDTLTRCTGYPLRHASLSLLSEDTVLHPPSRPHLKCLKNTPAFFAERLNKAMRGAGTKDRTLIRIMVSRSETDLLDIRSEYKRMYGKSLYHDISGDTSGDYRKILLKICGGND

SEQ ID NO: 824724 - protein, 542 aa, Homo sapiens; identical to SEQ ID NO: 824708

SEQ ID NO: 824725 - protein, 457 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRVCNFHVQVAMEP

SEQ ID NO: 824726 - protein, 312 aa, Homo sapiens
PLHCLWHLGQPRPRSFPPGADGCCARGSPVPRVPRGPREREWDPAPRQNPGAAPGTPAERATPAHVPFRPSRPESPWPDLTMSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQSWKRGHHLFSRVVTPSKFRGLGSAKASTDKQAHLRRGAPKGRGL

SEQ ID NO: 824727 - protein, 140 aa, Homo sapiens
RAAGNGAERGCAGASRGEAAAAMDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 824728 - protein, 140 aa, Homo sapiens; identical to SEQ ID NO: 824727

SEQ ID NO: 824729 - protein, 139 aa, Homo sapiens
GGGRLGRAGGPGFVLTPARRPQDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 824730 - protein, 139 aa, Homo sapiens; identical to SEQ ID NO: 824729

SEQ ID NO: 824731 - protein, 161 aa, Homo sapiens
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVHLHVHSQTMAKSRNTSWSQCPGLTACSTREPQDGPTQVHPRWGL

SEQ ID NO: 824732 - protein, 140 aa, Homo sapiens; identical to SEQ ID NO: 824727

SEQ ID NO: 824733 - protein, 183 aa, Homo sapiens
RAAGNGAERGCAGASRGEAAAAMDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVHLHVHSQTMAKSRNTSWSQCPGLTACSTREPQDGPTQVHPRWGL

SEQ ID NO: 824734 - protein, 85 aa, Homo sapiens
QRYRPRRAVDEIEDDQLLDDGKTLGECGFTSQTARPQAPATVGLAFRADDTFEALCIEPFSSPPELPDVMKPQDSGSSANEQAVQ

SEQ ID NO: 824735 - protein, 112 aa, Homo sapiens
RAAGNGAERGCAGASRGEAAAAMDVFLMIRRHKTTIFTDAKESSTVFELKRIVEGILKRPPDEQRLYKDDQLLDDGKTLGECGFTSQTARPQAPATVGLAFRAGERPTTHWA

SEQ ID NO: 824736 - protein, 88 aa, Homo sapiens
RAAGNGAERGCAGASRGEAAAAMDVFLMIRRHKTTIFTDAKESSTVFELKRIVEGILKRPPDEQRLYKMTPLRPCASSRFPARQSCPM

SEQ ID NO: 824737 - protein, 140 aa, Homo sapiens; identical to SEQ ID NO: 824727

SEQ ID NO: 824738 - protein, 140 aa, Homo sapiens; identical to SEQ ID NO: 824727

SEQ ID NO: 824739 - protein, 140 aa, Homo sapiens; identical to SEQ ID NO: 824727

SEQ ID NO: 824740 - protein, 161 aa, Homo sapiens; identical to SEQ ID NO: 824731

SEQ ID NO: 824741 - protein, 118 aa, Homo sapiens
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 824742 - protein, 139 aa, Homo sapiens; identical to SEQ ID NO: 824729

SEQ ID NO: 824743 - protein, 183 aa, Homo sapiens; identical to SEQ ID NO: 824733

SEQ ID NO: 824744 - protein, 163 aa, Homo sapiens
RAAGNGAERGCAGASRGEAAAAMDVFLMIRRHKTTIFTDAKESSTVFELKRIVEGILKRPPDEQRLYKLLVRSLWDLPHVGPLPRSCFSPQDDQLLDDGKTLGECGFTSQTARPQAPATVGLAFRADDTFEALCIEPFSSPPELPDVMKPQDSGSSANEQAVQ

SEQ ID NO: 824745 - protein, 163 aa, Homo sapiens; identical to SEQ ID NO: 824744

SEQ ID NO: 824746 - protein, 129 aa, Homo sapiens
GGGRLGRAGGPGFVLTPARRPQDVFLMIRRHKTTIFTDAKESSTVFELKRIVEGILKRPPDEQRLYKDDQLLDDGKTLGECGFTSQTARPQAPATVGLAFRAALLLPPQMTPLRPCASSRFPARQSCPM

SEQ ID NO: 824747 - protein, 317 aa, Homo sapiens
MSEGVGTFRMVPEEEQELRAQLEQLTTKDHGPVFGPCSQLPRHTLQKAKDELNEREETREEAVRELQEMVQAQAASGEELAVAVAERVQEKDSGFFLRFIRARKFNVGRAYELLRGYVNFRLQYPELFDSLSPEAVRCTIEAGYPGVLSSRDKYGRVVMLFNIENWQSQEITFDEILQAYCFILEKLLENEETQINGFCIIENFKGFTMQQAASLRTSDLRKMVDMLQDSFPARFKAIHFIHQPWYFTTTYNVVKPFLKSKLLERVFVHGDDLSGFYQEIDENILPSDFGGTLPKYDGKAVAEQLFGPQAQAENTAF

SEQ ID NO: 824748 - protein, 170 aa, Homo sapiens
DISNKYNFGKKRKEEPRRQLTLFLTSATILQAYCFILEKLLENEETQINGFCIIENFKGFTMQQAASLRTSDLRKMVDMLQDSFPARFKAIHFIHQPWYFTTTYNVVKPFLKSKLLERVFVHGDDLSGFYQEIDENILPSDFGGTLPKYDGKAVAEQLFGPQAQAENTAF

SEQ ID NO: 824749 - protein, 317 aa, Homo sapiens; identical to SEQ ID NO: 824747

SEQ ID NO: 824750 - protein, 343 aa, Homo sapiens
WKTQILGKKKGAFSVLASPGPFPRQHVKKEVGTFRMVPEEEQELRAQLEQLTTKDHGPVFGPCSQLPRHTLQKAKDELNEREETREEAVRELQEMVQAQAASGEELAVAVAERVQEKDSGFFLRFIRARKFNVGRAYELLRGYVNFRLQYPELFDSLSPEAVRCTIEAGYPGVLSSRDKYGRVVMLFNIENWQSQEITFDEILQAYCFILEKLLENEETQINGFCIIENFKGFTMQQAASLRTSDLRKMVDMLQDSFPARFKAIHFIHQPWYFTTTYNVVKPFLKSKLLERVFVHGDDLSGFYQEIDENILPSDFGGTLPKYDGKAVAEQLFGPQAQAENTAF

SEQ ID NO: 824751 - protein, 475 aa, Homo sapiens
SGARGRALHSDVTGTVRWVKVQPRPRFPLAVSLGLCRRRRRLWARLRSVCFATFSPSTARPAAMANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 824752 - protein, 475 aa, Homo sapiens; identical to SEQ ID NO: 824751

SEQ ID NO: 824753 - protein, 144 aa, Homo sapiens
SGARGRALHSDVTAHRALGQSSAPPPLPPRCLPRPVPPPQMQQIKLTPAQTRWEPFLPPSLNERRGLVSPGRQQLARSFASRSPPRKNRLDRGAQRIPAPREKLSAPRPSAPGLVLRGEERRGGRGRPHRAPRADGVVSWVPRP

SEQ ID NO: 824754 - protein, 475 aa, Homo sapiens; identical to SEQ ID NO: 824751

SEQ ID NO: 824755 - protein, 475 aa, Homo sapiens; identical to SEQ ID NO: 824751

SEQ ID NO: 824756 - protein, 329 aa, Homo sapiens [sequence omitted]

SEQ ID NO: 824757 - protein, 475 aa, Homo sapiens; identical to SEQ ID NO: 824751

SEQ ID NO: 824758 - protein, 329 aa, Homo sapiens [sequence omitted]

SEQ ID NO: 824759 - protein, 475 aa, Homo sapiens; identical to SEQ ID NO: 824751

SEQ ID NO: 824760 - protein, 465 aa, Homo sapiens
SGARGRALHSDVTGTVRWVKVQPRPRFPLAVSLGLCRRRRRLWARLRSVCFATFSPSTARPAAMANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDFCIKAEGPTIGQQGGKSGLCLGPGGKGAKMREKGGPGGGPDAKSGFLVS

SEQ ID NO: 824761 - protein, 291 aa, Homo sapiens
SGARGRALHSDVTGTVRWVKVQPRPRFPLAVSLGLCRRRRRLWARLRSVCFATFSPSTARPAAMANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGMCASTSLLLCWNGLGMQILERFTIFYFKGYLYTSY

SEQ ID NO: 824762 - protein, 191 aa, Homo sapiens
SGARGRALHSDVTGTVRWVKVQPRPRFPLAVSLGLCRRRRRLWARLRSVCFATFSPSTARPAAMANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRWHTEHSRMPHSLAPTSRPPTP

SEQ ID NO: 824763 - protein, 104 aa, Homo sapiens
MQQIKLTPAQTRWEPFLPPSLNERRGLVSPGRQQLARSFASRSPPRKNRLDRGAQRIPAPREKLSAPRPSAPGLVLRGEERRGGRGRPHRAPRADGVVSWVPRP

SEQ ID NO: 824764 - protein, 412 aa, Homo sapiens
MANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 824765 - protein, 475 aa, Homo sapiens; identical to SEQ ID NO: 824751

SEQ ID NO: 824766 - protein, 329 aa, Homo sapiens [sequence omitted]

SEQ ID NO: 824767 - protein, 252 aa, Homo sapiens
GTSSFSITIRAHRLHLLYHPWSQLSDHDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 824768 - protein, 450 aa, Homo sapiens
SGARGRALHSDVTGTVRWVKVQPRPRFPLAVSLGLCRRRRRLWARLRSVCFATFSPSTARPAAMANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDGCCFLHQSYH

SEQ ID NO: 824769 - protein, 435 aa, Homo sapiens
SGARGRALHSDVTGTVRWVKVQPRPRFPLAVSLGLCRRRRRLWARLRSVCFATFSPSTARPAAMANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSEPEEEEEDMMHPLKVSLEDLYNG

SEQ ID NO: 824770 - protein, 1091 aa, Homo sapiens
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGKIKREELDVKHALSYNQRQLKELKDSKTDRLKRFGPNVPALLEAIDDAYRQGHFTYKPVGPLGACIHLRDPELALAIESCLKGLLQAYCCHNHADERVLQALMKRFYLPGTSRPPIIVSEFRNEIYDVRHRAAYHPDFPTVLTALEIDNAVVANSLIDMRGIETVLLIKNNSVARAVMQSQKPPKNCREAFTADGDQVFAGRYYSSENTRPKFLSRDVDSEISDLENEVENKTAQILNLQQHLSALEKDIKHNEELLKRCQLHYKELKMKIRKNISEIRELENIEEHQSVDIATLEDEAQENKSKMKMVEEHMEQQKENMEHLKSLKIEAENKYDAIKFKINQLSELADPLKDELNLADSEVDNQKRGKRHYEEKQKEHLDTLNKKKRELDMKEKELEEKMSQARQICPERIEVEKSASILDKEINRLRQKIQAEHASHGDREEIMRQYQEARETYLDLDSKVRTLKKFIKLLGEIMEHRFKTYQQFRRCLTLRCKLYFDNLLSQRAYCGKMNFDHKNETLSISVQPGEGNKAAFNDMRALSGGERSFSTVCFILSLWSIAESPFRCLDEFDVYMDMVNRRIAMDLILKMADSQRFRQFILLTPQSMSSLPSSKLIRILRMSDPERGQTTLPFRPVTQEEDDDQR

SEQ ID NO: 824771 - protein, 1091 aa, Homo sapiens; identical to SEQ ID NO: 824770

SEQ ID NO: 824772 - protein, 1091 aa, Homo sapiens; identical to SEQ ID NO: 824770

SEQ ID NO: 824773 - protein, 374 aa, Homo sapiens
MQSEGGGEERGLAGTTLLILHRYSEDEAQENKSKMKMVEEHMEQQKENMEHLKSLKIEAENKYDAIKFKINQLSELADPLKDELNLADSEVDNQKRGKRHYEEKQKEHLDTLNKKKRELDMKEKELEEKMSQARQICPERIEVEKSASILDKEINRLRQKIQAEHASHGDREEIMRQYQEARETYLDLDSKVRTLKKFIKLLGEIMEHRFKTYQQFRRCLTLRCKLYFDNLLSQRAYCGKMNFDHKNETLSISVQPGEGNKAAFNDMRALSGGERSFSTVCFILSLWSIAESPFRCLDEFDVYMDMVNRRIAMDLILKMADSQRFRQFILLTPQSMSSLPSSKLIRILRMSDPERGQTTLPFRPVTQEEDDDQR

SEQ ID NO: 824774 - protein, 216 aa, Homo sapiens
RIPHRFAGLPGDREEIMRQYQEARETYLDLDSKVRTLKKFIKLLGEIMEHRFKTYQQFRRCLTLRCKLYFDNLLSQRAYCGKMNFDHKNETLSISVQPGEGNKAAFNDMRALSGGERSFSTVCFILSLWSIAESPFRCLDEFDVYMDMVNRRIAMDLILKMADSQRFRQFILLTPQSMSSLPSSKLIRILRMSDPERGQTTLPFRPVTQEEDDDQR

SEQ ID NO: 824775 - protein, 1091 aa, Homo sapiens; identical to SEQ ID NO: 824770

SEQ ID NO: 824776 - protein, 1091 aa, Homo sapiens; identical to SEQ ID NO: 824770

SEQ ID NO: 824777 - protein, 561 aa, Homo sapiens
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGKIKREELDVKHALSYNQRQLKELKDSKTDRLKRFGPNVPALLEAIDDAYRQGHFTYKPVGPLGACIHLRDPELALAIESCLKGLLQAYCCHNHADERVLQALMKRFYLPGPHGHR

SEQ ID NO: 824778 - protein, 394 aa, Homo sapiens
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKR

SEQ ID NO: 824779 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 824780 - protein, 108 aa, Homo sapiens
MADELSEKQVYDAHTKEIDLVNRDPKHLNDDVVKIDFEDVIAEPEGTHSFDGIWKASFTTFTCWTENLLWEFYTPALAGLALLWHPDGHFIPGGAILTFRPISSSFPG

SEQ ID NO: 824781 - protein, 147 aa, Homo sapiens
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 824782 - protein, 178 aa, Homo sapiens; identical to SEQ ID NO: 824779

SEQ ID NO: 824783 - protein, 178 aa, Homo sapiens; identical to SEQ ID NO: 824779

SEQ ID NO: 824784 - protein, 178 aa, Homo sapiens; identical to SEQ ID NO: 824779

SEQ ID NO: 824785 - protein, 178 aa, Homo sapiens; identical to SEQ ID NO: 824779

SEQ ID NO: 824786 - protein, 147 aa, Homo sapiens; identical to SEQ ID NO: 824781

SEQ ID NO: 824787 - protein, 147 aa, Homo sapiens; identical to SEQ ID NO: 824781

SEQ ID NO: 824788 - protein, 178 aa, Homo sapiens; identical to SEQ ID NO: 824779

SEQ ID NO: 824789 - protein, 178 aa, Homo sapiens; identical to SEQ ID NO: 824779

SEQ ID NO: 824790 - protein, 185 aa, Homo sapiens
TIIYKPPLIKYCVLIYNFPMSQTVSHGAPAHIARFWYDTTTNKPSSEMFNIFILLVSLLNIFSIGEVCSPTMCHPHRLSIVVPLHHQVSHRLDTVFARLQPPCCYPPRPRSPLVFIILDRPSSMWAPPFTTKRLRSPRVNVGAPSGVIFAPPPFFFFFFFFFFSFYLHVDQPSLYWLRYEHIVER

SEQ ID NO: 824791 - protein, 83 aa, Homo sapiens
MSGGKYVDSEGHLYTVPIREQGNIYKPNNKAMADELSEKQVYDAHTKEIDLVNRDPKHLNDDVVKNLFEDVDQNPEGGQQKFF

SEQ ID NO: 824792 - protein, 695 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824793 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824794 - protein, 137 aa, Homo sapiens
AGSADSPGSEPRRRARAPSVSSAAVGESTRRSVRGGPGRRRRWRRGQSKDAADPTRTAAHSVPRAGSRCCPVWHCSCWPPGRLGRWRWRFALVTWAGVQWCDLGSPQPPPPGFKRFSCLSLLSSWDYGWPLTIFTSM

SEQ ID NO: 824795 - protein, 717 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824796 - protein, 736 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824797 - protein, 686 aa, Homo sapiens
MFPELQNCAKVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824798 - protein, 717 aa, Homo sapiens; identical to SEQ ID NO: 824795

SEQ ID NO: 824799 - protein, 381 aa, Homo sapiens
GSRGSLAYGKGQARERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824800 - protein, 717 aa, Homo sapiens; identical to SEQ ID NO: 824795

SEQ ID NO: 824801 - protein, 699 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824802 - protein, 248 aa, Homo sapiens
MRSDRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824803 - protein, 668 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLHGGRCCHSDSDRHHLGDAEEETVHIHSSWCGGG

SEQ ID NO: 824804 - protein, 731 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKLASEVGQQNHCFTTHRCPFIE

SEQ ID NO: 824805 - protein, 332 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824806 - protein, 717 aa, Homo sapiens; identical to SEQ ID NO: 824795

SEQ ID NO: 824807 - protein, 717 aa, Homo sapiens; identical to SEQ ID NO: 824795

SEQ ID NO: 824808 - protein, 717 aa, Homo sapiens; identical to SEQ ID NO: 824795

SEQ ID NO: 824809 - protein, 717 aa, Homo sapiens; identical to SEQ ID NO: 824795

SEQ ID NO: 824810 - protein, 717 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFGIFIGR

SEQ ID NO: 824811 - protein, 765 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKLSSFENAYAHAINDAGDVVGSYKDQLGNAHAYLSSAQGTIIEIGPQPGVTNYRGL

SEQ ID NO: 824812 - protein, 693 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKRGSEPGETWLLSREKPGSEP

SEQ ID NO: 824813 - protein, 660 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLVTPPESCK

SEQ ID NO: 824814 - protein, 668 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLLNLLFVTEMRVSNKTQSLDFDGVFHSSSPGVTS

SEQ ID NO: 824815 - protein, 646 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMFWGKKFNHQGKEMTKQKKVCSAAHDGEY

SEQ ID NO: 824816 - protein, 610 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPVWVVIAFRL

SEQ ID NO: 824817 - protein, 529 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVGAVAHACNSSILGGQGGQMT

SEQ ID NO: 824818 - protein, 465 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVMSEEVDSGATEAQKEAVSLP

SEQ ID NO: 824819 - protein, 370 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQHERMGRGRTPDASLV

SEQ ID NO: 824820 - protein, 335 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKRTLSFT

SEQ ID NO: 824821 - protein, 266 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRGGNAGGSLCASS

SEQ ID NO: 824822 - protein, 200 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGRQIQFSLTSLKFHL

SEQ ID NO: 824823 - protein, 109 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLGEPAGRGAGVDWGPGLEGRKRGCSC

SEQ ID NO: 824824 - protein, 135 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHPQRFILPQRFILPQRFILSQRFILPQRFILPY

SEQ ID NO: 824825 - protein, 190 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDK

SEQ ID NO: 824826 - protein, 305 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREKWYKEVHSGQARWLML

SEQ ID NO: 824827 - protein, 661 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824828 - protein, 650 aa, Homo sapiens
HLEDPVSSPFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824829 - protein, 467 aa, Homo sapiens
TGLGNPSLPATYTRAQVEEGDPTVIATTTTTTTESVEEVVRVSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824830 - protein, 717 aa, Homo sapiens; identical to SEQ ID NO: 824795

SEQ ID NO: 824831 - protein, 289 aa, Homo sapiens
RGSPGVSCIVGSPELCVHAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824832 - protein, 717 aa, Homo sapiens; identical to SEQ ID NO: 824795

SEQ ID NO: 824833 - protein, 377 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVLG

SEQ ID NO: 824834 - protein, 191 aa, Homo sapiens
MISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 824835 - protein, 717 aa, Homo sapiens; identical to SEQ ID NO: 824795

SEQ ID NO: 824836 - protein, 717 aa, Homo sapiens; identical to SEQ ID NO: 824795

SEQ ID NO: 824837 - protein, 717 aa, Homo sapiens; identical to SEQ ID NO: 824795

SEQ ID NO: 824838 - protein, 75 aa, Homo sapiens
GTQIPLSIPHPFIMVWWRLTPLSPQRSATCPRCSRTATKIQPTSSLSRCRTRPPPQQPLKLDSKTIASLPIGVHL

SEQ ID NO: 824839 - protein, 712 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKLK

SEQ ID NO: 824840 - protein, 701 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVELRRCDPRGAHIVTGELI

SEQ ID NO: 824841 - protein, 654 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLVI

SEQ ID NO: 824842 - protein, 655 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVLCRRCGSSASSVYPQERAM

SEQ ID NO: 824843 - protein, 597 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEGKSPLSECQRNPGR

SEQ ID NO: 824844 - protein, 511 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVGK

SEQ ID NO: 824845 - protein, 377 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQHENKRKKMKIKSLFICFSFSLV

SEQ ID NO: 824846 - protein, 376 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTDTSVILLAEVKGPLISSATWGSFSEQHVQLSSLLVQLEGFCLLGHLLSLGSGSGPYGK

SEQ ID NO: 824847 - protein, 190 aa, Homo sapiens; identical to SEQ ID NO: 824825

SEQ ID NO: 824848 - protein, 209 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGRVRWPLCSASEMLKHLVWSICIL

SEQ ID NO: 824849 - protein, 128 aa, Homo sapiens
MKYKALSSTLYTSQNGKWDSDPSGTKTCIDTKEGILQYCQEVYPELQITNVVEANQPVTIQNWCKRGRKQCKTHPHFVIPYRCLVGEFVSDAILVSQGCLFCHGAHSGCWRLFCSSEPRRMGYVMCGY

SEQ ID NO: 824850 - protein, 112 aa, Homo sapiens
DSGCQGGTFRSSRNSEPLYTIMSLFTYLHRARGCTGPDLTMTPPSCCPANPRCLSPATPKCLSPASPRFQSPASPRCLSPALQRSLQHQPSRRPSRSNVVHSHALEELATGY

SEQ ID NO: 824851 - protein, 72 aa, Homo sapiens
RYPSRDRRLYLNMEPCIPKTKEPCQPKVPEPCHPKVPEPCQPKIPEPCQPKVPEPCPSTVTPAPAQQKTKQK

SEQ ID NO: 824852 - protein, 175 aa, Homo sapiens
ARSPGKSWFFSHRVKQETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETASLTLFRRCRWTSLIVGTKMGTLNKHHSPH

SEQ ID NO: 824853 - protein, 118 aa, Homo sapiens [sequence omitted]

SEQ ID NO: 824854 - protein, 152 aa, Homo sapiens
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824855 - protein, 152 aa, Homo sapiens; identical to SEQ ID NO: 824854

SEQ ID NO: 824856 - protein, 180 aa, Homo sapiens
RLVRGWCGSAEGERSRRRDQRPNSGSDKMAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824857 - protein, 152 aa, Homo sapiens; identical to SEQ ID NO: 824854

SEQ ID NO: 824858 - protein, 312 aa, Homo sapiens
TVKRDARAVARGSCRTTVAGRLGHERQSPAPPLAACPKSLPRNRASLPPSPAAVGAGRTGEGARSEGSPPVPEPAPEQGLHFPRGLGGGCGDGRGNVPRKWSPGLPLVREARGAGDETRGRTRVLTRWPGCPAGSSSYDGFTEKNMKILGAEGASHMDILGRKRKYKALEETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824859 - protein, 174 aa, Homo sapiens
MISWGSPGQVNSEPFSQITSDKMAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824860 - protein, 152 aa, Homo sapiens; identical to SEQ ID NO: 824854

SEQ ID NO: 824861 - protein, 156 aa, Homo sapiens
GSQAPLLRPDGAAEETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824862 - protein, 152 aa, Homo sapiens; identical to SEQ ID NO: 824854

SEQ ID NO: 824863 - protein, 134 aa, Homo sapiens
MAGLPRRIIKETQRLLAEPVPGIKAEPDESNARYFHVVIAGPQDSPFEGGTFKLELFLPEEYPMAAPKVRFMTKNKWSPALQIRTVLLSIQALLSAPNPDDPLANDVAEQWKTNEAQAIETARAWTRLYAMNNI

SEQ ID NO: 824864 - protein, 152 aa, Homo sapiens; identical to SEQ ID NO: 824854

SEQ ID NO: 824865 - protein, 152 aa, Homo sapiens; identical to SEQ ID NO: 824854

SEQ ID NO: 824866 - protein, 169 aa, Homo sapiens
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETASLTLFRRCRWTSLIVGTKMGTLNKHHSPH

SEQ ID NO: 824867 - protein, 120 aa, Homo sapiens
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDP

SEQ ID NO: 824868 - protein, 95 aa, Homo sapiens
MAGLPRRIIKETQRLLAEPVPGIKAEPDESNARYFHVVIAGPQDSPFEGGTFKLELFLPEEYPMAAPKVRFMTKIYHPNVDKLTCRLSSARLVQV

SEQ ID NO: 824869 - protein, 173 aa, Homo sapiens
GSQAPLLRPDGAAEETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETASLTLFRRCRWTSLIVGTKMGTLNKHHSPH

SEQ ID NO: 824870 - protein, 152 aa, Homo sapiens; identical to SEQ ID NO: 824854

SEQ ID NO: 824871 - protein, 152 aa, Homo sapiens; identical to SEQ ID NO: 824854

SEQ ID NO: 824872 - protein, 152 aa, Homo sapiens; identical to SEQ ID NO: 824854

SEQ ID NO: 824873 - protein, 165 aa, Homo sapiens
ARYEAGVDRPRDKMAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824874 - protein, 178 aa, Homo sapiens
NIQVTAWPGLYWIQSNLNVAVDFTDKMAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 824875 - protein, 152 aa, Homo sapiens; identical to SEQ ID NO: 824854

SEQ ID NO: 824876 - protein, 152 aa, Homo sapiens; identical to SEQ ID NO: 824854

SEQ ID NO: 824877 - protein, 195 aa, Homo sapiens
TVKRDARAVARGSCRTTVAGRLGHERQSPAPPLAACPKSLPRNRASLPPSPAAVGAGRTGEGARSEGSPPVPEPAPEQGLHFPRGLGGGCGDGRGNVPRKWSPGLPLVREARGAGDETRGRTRVLTRWPGCPAGSSRKPSVCWQNQFLASKPNQMRATPVIFMWSLLALRIPPLREGLLNLNYSFQKNTQWQPLK

SEQ ID NO: 824878 - protein, 152 aa, Homo sapiens; identical to SEQ ID NO: 824854

SEQ ID NO: 824879 - protein, 152 aa, Homo sapiens; identical to SEQ ID NO: 824854

SEQ ID NO: 824880 - protein, 195 aa, Homo sapiens; identical to SEQ ID NO: 824877

SEQ ID NO: 824881 - protein, 110 aa, Homo sapiens
MISWGSPGQVNSEPFSQITSDKMAGLPRRIIKETQRLLAEPVPGIKAEPDESNARYFHVVIAGPQDSPFEGGTFKLELFLPEEYPMAAPKVRFMTKIYHPNVDKFKSNFI

SEQ ID NO: 824882 - protein, 733 aa, Homo sapiens
PVGAAGAGRGRGRGADVAARPAASGPVRRGGGGRSARPSPARSCGGAQSWFLTAFCRGRVCHQVLGSAPARPDLAPRFSAMALVRGAEPAAGPSRWLPTHVQVTVLRARGLRGKSSGAGSTSDAYTVIQVGREKYSTSVVEKTHGCPEWREECSFELPPGALDGLLRAQEADAGPAPWAASSAAACELVLTTMHRSLIGVDKFLGQATVALDEVFGAGRAQHTQWYKLHSKPGKKEKERGEIEVTIQFTRNNLSASMFDLSMKDKPRSPFSKIRDKMKGKKKYDLESASAILPSSAIEDPDLGSLGKMGKAKGFFLRNKLRKSSLTQSNTSLGSDSTLSSASGSLAYQGPGAELLTRSPSRSSWLSTEGGRDSAQSPKLFTHKRTYSDEANQMRVAPPRALLDLQGHLDAASRSSLCVNGSHIYNEEPQGPVRHRSSISGSLPSSGSLQAVSSRFSEEGPRSTDDTWPRGSRSNSSSEAVLGQEELSAQAKVLAPGASHPGEEEGARLPEGKPVQVATPIVASSEAVAEKEGARKEERKPRMGLFHHHHQGLSRSELGRRSSLGEKGGPILGASPHHSSSGEEKAKSSWFGLREAKDPTQKPSPHPVKPLSAAPVEGSPDRKQSRSSLSIALSSGLEKLKTVTSGSIQPVTQAPQAGQMVDTKRLKDSAVLDQSAKYYHLTHDELISLLLQRERELSQRDEHVQELESYIDRLLVRIMETSPTLLQIPPGPPK

SEQ ID NO: 824883 - protein, 575 aa, Homo sapiens
MEMFWIVSQLHLKPGSPGRWVRAGAFGERLSVALRARRGLGSAWYRAGARLPGPVTEFCLLPSSHRWYKLHSKPGKKEKERGEIEVTIQFTRNNLSASMFDLSMKDKPRSPFSKIRDKMKGKKKYDLESASAILPSSAIEDPDLGSLGKMGKAKGFFLRNKLRKSSLTQSNTSLGSDSTLSSASGSLAYQGPGAELLTRSPSRSSWLSTEGGRDSAQSPKLFTHKRTYSDEANQMRVAPPRALLDLQGHLDAASRSSLCVNGSHIYNEEPQGPVRHRSSISGSLPSSGSLQAVSSRFSEEGPRSTDDTWPRGSRSNSSSEAVLGQEELSAQAKVLAPGASHPGEEEGARLPEGKPVQVATPIVASSEAVAEKEGARKEERKPRMGLFHHHHQGLSRSELGRRSSLGEKGGPILGASPHHSSSGEEKAKSSWFGLREAKDPTQKPSPHPVKPLSAAPVEGSPDRKQSRSSLSIALSSGLEKLKTVTSGSIQPVTQAPQAGQMVDTKRLKDSAVLDQSAKYYHLTHDELISLLLQRERELSQRDEHVQELESYIDRLLVRIMETSPTLLQIPPGPPK

SEQ ID NO: 824884 - protein, 699 aa, Homo sapiens
ALPSASRASPTPLASPGKALPEWDNTFNVFAASRLRPEARSEILAPAGVGLEAAGLQDPGPGAMTAKAAEPQGEPGGGGGGGGGGGGRGGSSVWLEPRVPLDLGPNHQSASAADPGLLGSVGAGLPSSSAQLQLRASGSEPDRELPAPEVEAGQSPADSGTSLFSSPEVISVWERLPGPESAAEGQDDESSRGENQLCPDVETADDAWPWDVVTISPAAETASLVFRGESDEPAPQVQPESPETVSPKGSEGLPPPEPEPKPEWVSDKGLQPSTPPPKPPRLFTPSRSQEEEEEKAAVGLSNRGPETEGEDASPSALVVGPPETKEEGEKRESEESDSCSSATLLGQPGLEELVEDASPPVSGPCLSAPASCPEGPAPIPCHSKSLALQSQHIWGTPEVGEGPEAPEAQGQDPVGEGLGSLSATSQQADVWVSKEDALNPFLFQGSRDPPSLSSASPPGSRESSIHSGPEELPTPPEPDFPPPPLPPWASHHRGGPSPPCSPLSEAWPLTTSSAPPGEPALLPGPHEPSPPGGSPALLREDLAAATPASPLVLLPLETRPAEEPQPSASPHPVKPLSAAPVEGSPDRKQSRSSLSIALSSGLEKLKTVTSGSIQPVTQAPQAGQMVDTKRLKDSAVLDQSAKYYHLTHDELISLLLQRERELSQRDEHVQELESYIDRLLVRIMETSPTLLQIPPGPPK

SEQ ID NO: 824885 - protein, 699 aa, Homo sapiens; identical to SEQ ID NO: 824884

SEQ ID NO: 824886 - protein, 699 aa, Homo sapiens; identical to SEQ ID NO: 824884

SEQ ID NO: 824887 - protein, 654 aa, Homo sapiens
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKDSPALKTLQDDFLEFAKDKNFQVLNFVETLPTYIGSMIKLHVVPVESADLGIGDLIPVDVNHLNICKPKKKDAFLYQRTLQFIREALAKDLEN

SEQ ID NO: 824888 - protein, 587 aa, Homo sapiens
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKGNTFCHKGNWGYINISYTEKKKKFLP

SEQ ID NO: 824889 - protein, 195 aa, Homo sapiens [sequence omitted]

SEQ ID NO: 824890 - protein, 283 aa, Homo sapiens
MVRPGMVEGALAGGDWGGGEEAVWPPYLLWLGASGLERCEESLRPRCISLQLTRSAFARPQLLLPPPAVLGTWLPWPRGACLTGLCTSDPCEPVFLCASTPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 824891 - protein, 77 aa, Homo sapiens
KFKNKTVLKKRCKDCYLLKRLCRWYVYCPSPRLYTESPAEAPAGGTQHLLVLEPSITFTLSHHGPGTKPALGSTAVG

SEQ ID NO: 824892 - protein, 156 aa, Homo sapiens
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 824893 - protein, 156 aa, Homo sapiens; identical to SEQ ID NO: 824892

SEQ ID NO: 824894 - protein, 156 aa, Homo sapiens; identical to SEQ ID NO: 824892

SEQ ID NO: 824895 - protein, 156 aa, Homo sapiens; identical to SEQ ID NO: 824892

SEQ ID NO: 824896 - protein, 156 aa, Homo sapiens; identical to SEQ ID NO: 824892

SEQ ID NO: 824897 - protein, 251 aa, Homo sapiens
MKDTSAYPFLFQYAGRVSFMLLGTGSYNILPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 824898 - protein, 162 aa, Homo sapiens
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLELQKHLPVALSTSLC

SEQ ID NO: 824899 - protein, 137 aa, Homo sapiens
MEICADELKKVLNTVVNKHKDLKTHGFTLESCRSMIALMDTDGSGKLNLQEFHHLWNKIKAWQMRNESTTRFHLNNQLYDIITMRYADKHMNIDFDSFICCFVRLEGMFRAFHAFDKDGDGIIKLNVLEWLQLTMYA

SEQ ID NO: 824900 - protein, 129 aa, Homo sapiens
RNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDP

SEQ ID NO: 824901 - protein, 324 aa, Homo sapiens
PLWTVFWAVTVMVIILTLSQCQVSKCLLNDHRRLVLVVGKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFMPLTRWDGIISSSSGSGAAHMCGLTGGSFKHGEPPIRSPFSSFLQARYPRPGLGVPISPTLGQRFKGGEPLRRERRPGVSGGA

SEQ ID NO: 824902 - protein, 246 aa, Homo sapiens
MSRAGVIRSGPSHKLMVAGRRPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNSSMTSLPCGKLEGMFRAFHAFDQAGDGFIKAHRLEAVGNPVRWLRPLGVKLHNFRGPRADPHGFC

SEQ ID NO: 824903 - protein, 156 aa, Homo sapiens; identical to SEQ ID NO: 824892

SEQ ID NO: 824904 - protein, 156 aa, Homo sapiens; identical to SEQ ID NO: 824892

SEQ ID NO: 824905 - protein, 156 aa, Homo sapiens; identical to SEQ ID NO: 824892

SEQ ID NO: 824906 - protein, 156 aa, Homo sapiens; identical to SEQ ID NO: 824892

SEQ ID NO: 824907 - protein, 244 aa, Homo sapiens
RNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 824908 - protein, 215 aa, Homo sapiens
MGGVASTLQGLPMRLGYTGAGGFPGVCLEHLEPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 824909 - protein, 114 aa, Homo sapiens
GCRIRHESPQPGSSDQESEEQQQFRNIFKQIAGDDMEICADELKKVLNTVVNKHKDLKTHGFTLESCRSMIALMDTDGSGKLNLQEFHHLWNKIKAWQMRNAVNDAIPPQQPAL

SEQ ID NO: 824910 - protein, 160 aa, Homo sapiens
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNSSMTSLPCGKLEGMFRAFHAFDQAGDGFIKAHRLEAVGNPVRWLRPLGVKLHNFRGPRADPHGFC

SEQ ID NO: 824911 - protein, 1003 aa, Homo sapiens
RRSGILRAEGGGSAGAGDRLGGFGKQFGAGGRPCYSASRPVSARLAAPWPPASSNVSHRPGVAAARARNRGAMSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 824912 - protein, 136 aa, Homo sapiens
RRSGILRAEGGGSAGAGDRLGGFGKQFGAGGRPCYSASRPVSARLAAPWPPASSNVSHRPGVAAARARNRGAMSEAGGRGCGSPVPQRARWRLVAATAAFCLVSATSVWTAGAEPMSREEKQKLGNMLTLLMNSCL

SEQ ID NO: 824913 - protein, 228 aa, Homo sapiens
RRSGILRAEGGGSAGAGDRLGGFGKQFGAGGRPCYSASRPVSARLAAPWPPASSNVSHRPGVAAARARNRGAMSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLLEVITSSHQPYSIPCLVCNLSHKARIANSYIHFVPFFCLTEP

SEQ ID NO: 824914 - protein, 228 aa, Homo sapiens; identical to SEQ ID NO: 824913

SEQ ID NO: 824915 - protein, 1003 aa, Homo sapiens; identical to SEQ ID NO: 824911

SEQ ID NO: 824916 - protein, 1003 aa, Homo sapiens; identical to SEQ ID NO: 824911

SEQ ID NO: 824917 - protein, 125 aa, Homo sapiens
RRSGILRAEGGGSAGAGDRLGGFGKQFGAGGRPCYSASRPVSARLAAPWPPASSNVSHRPGVAAARARNRGAMSEAGGRGCGSPVPQRARWRLVAATAAFCLVSATSVWTAGAEPMSREEKQKLG

SEQ ID NO: 824918 - protein, 958 aa, Homo sapiens
RRSGILRAEGGGSAGAGDRLGGFGKQFGAGGRPCYSASRPVSARLAAPWPPASSNVSHRPGVAAARARNRGAMSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLANMQSKVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 824919 - protein, 1003 aa, Homo sapiens; identical to SEQ ID NO: 824911

SEQ ID NO: 824920 - protein, 115 aa, Homo sapiens; identical to SEQ ID NO: 762671

SEQ ID NO: 824921 - protein, 715 aa, Homo sapiens
MAYIKMFYKYSQKLLFYCMQRVMAIFNSNVFKYFELKLNLTNVKLPQRRLEKRKVIKSCFIIKYHYKQVFQMYYFTCLEKIAQKARWPANPVSMSIGKNPGHKVNSEQSFLSAAGLDKQRERLERVFLLQLIGRSDGIMEYCDLFCFFFFLVFYSFDMKFFKEVNIYSMLQLVLTKRCHSRSVSLAFIRRRLNAGNHFLSSTSKSPIVQLNPVMNCKLFASAQTEELLDGLGDLSGGTCASTPCIRKTSPGSWETLLWVWSFYQSCKRSLCPCFVGELLVFKGTMELEREKWGIEQVKTTTDFAVLIEVQQLFLNYCPLDCCKPLVNFQSFEENDFDNFPSIFIVIMEECIFLGYSRSPTSLLRFYNGISYGYPKYTWQVVLETTNNSLLKIQKLLLLANKINEINLIIVEEIKFFKIKKLQMLKFSTMLIQTFSYTTNCPGLILNTSQKIYLFYTRKAKYGPQCIFGLSASTVAIIFKRLKTLNFVNMLINCLLGFINFKIYRDYPIQLYLYPISNSPEQLYTLAKTLQMIYKEKVKYTTEFIQLSKDAQNLSVSLTPSLNPHTTSEEKMIWCNDASILNAEGLITCPFQAVTEACPLDPGILSISPLKVTQSHTSLKQRPLDASTPDFFYLHFNISPYSNPHFSTPCHLRKGILSPLFHSKLLKFVPLILPLPNIPRLAPLIISSLGILISSSSLDPSPQPLKLLDLKTLSVI

SEQ ID NO: 824922 - protein, 652 aa, Homo sapiens [sequence omitted]

SEQ ID NO: 824923 - protein, 652 aa, Homo sapiens [sequence omitted]

SEQ ID NO: 824924 - protein, 652 aa, Homo sapiens [sequence omitted]

SEQ ID NO: 824925 - protein, 241 aa, Homo sapiens
YVVGAEVGGSTRRWAARDEACVISDTIYSESVLGFTAQKSGPEAVVSFRSESSVSNQARSLSGEDGFRDVAGFVRFFVFGCRWNSGSRLHCSVSSAPRGPASGPVTCRYWESTAKTPGHPGSLEMDNLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPDGVSLLFPRPE

SEQ ID NO: 824926 - protein, 251 aa, Homo sapiens
MGAEVRRLYSAVGGPRLSFVISDTIYSESVLGFTAQKSGPEAVVSFRSESSVSNQARSLSGEDGFRDVAGFVRFFVFGCRWNSGSRLHCSVSSAPRGPASGPVTCRYWESTAKTPGHPGSLEMDNLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPGIFFVVRGGLHKTFKRYNVFQSS

SEQ ID NO: 824927 - protein, 241 aa, Homo sapiens; identical to SEQ ID NO: 824925

SEQ ID NO: 824928 - protein, 259 aa, Homo sapiens
MGAEVRRLYSAVGGPRLSFVISDTIYSESVLGFTAQKSGPEAVVSFRSESSVSNQARSLSGEDGFRDVAGFVRFFVFGCRWNSGSRLHCSVSSAPRGPASGPVTCRYWESTAKTPGHPGSLEMDNLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPESGVLKFPTIIILLSRCFFQSVNICFIYLEP

SEQ ID NO: 824929 - protein, 170 aa, Homo sapiens
MSDTIYSESVLGFTAQKSGPEAVVSFRSESSVSNQARSLSGEDGFRDVAGFVRFFVFGCRWNSGSRLHCSVSSAPRGPASGPVTCRYWESTAKTPGHPGSLEMDNLRYGVYPVKGASGYPGAERNLLEYSYFEKTEFRSCCPGWSAMARSQLTSTSASRVQAILLPQPPE

SEQ ID NO: 824930 - protein, 380 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 824931 - protein, 380 aa, Homo sapiens; identical to SEQ ID NO: 824930

SEQ ID NO: 824932 - protein, 305 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSGE

SEQ ID NO: 824933 - protein, 117 aa, Homo sapiens [sequence omitted]

SEQ ID NO: 824934 - protein, 239 aa, Homo sapiens
MRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 824935 - protein, 380 aa, Homo sapiens; identical to SEQ ID NO: 824930

SEQ ID NO: 824936 - protein, 102 aa, Homo sapiens
MEKSMGKEIAPLPRPSSEFPQWERTRKQGRSPSPSPTCPSGGGDSQGAPLGYNIGERSEIAEASRVQSCPFKRPPPPRLEAHAAPLRRGALWVRGVEFWNEM

SEQ ID NO: 824937 - protein, 212 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPDASRWEVHGKESTREQGARRGRTEQQKKKKKKERQGKQKKKKEQKRKNK

SEQ ID NO: 824938 - protein, 135 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSPLLGMHQ

SEQ ID NO: 824939 - protein, 305 aa, Homo sapiens; identical to SEQ ID NO: 824932

SEQ ID NO: 824940 - protein, 305 aa, Homo sapiens; identical to SEQ ID NO: 824932

SEQ ID NO: 824941 - protein, 102 aa, Homo sapiens; identical to SEQ ID NO: 824936

SEQ ID NO: 824942 - protein, 102 aa, Homo sapiens; identical to SEQ ID NO: 824936

SEQ ID NO: 824943 - protein, 380 aa, Homo sapiens; identical to SEQ ID NO: 824930

SEQ ID NO: 824944 - protein, 123 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGSSPARRST

SEQ ID NO: 824945 - protein, 276 aa, Homo sapiens
MSETVICSSRATVMLYDDGNKRWLPAGTGPQAFSRVQIYHNPTANSFRVVGRKMQPDQQVVINCAIVRGVKYNQLQVPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 824946 - protein, 256 aa, Homo sapiens
AQPGAGVWGRGLPGGSPHLQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 824947 - protein, 117 aa, Homo sapiens [sequence omitted]

SEQ ID NO: 824948 - protein, 380 aa, Homo sapiens; identical to SEQ ID NO: 824930

SEQ ID NO: 824949 - protein, 179 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPDGGPGGGAGGVEG

SEQ ID NO: 824950 - protein, 305 aa, Homo sapiens; identical to SEQ ID NO: 824932

SEQ ID NO: 824951 - protein, 195 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKSRRPAVEHIERGLHGRRPTCHARTDHKPRQPTQNTQEHQPTTAHDNNTSTHLT

SEQ ID NO: 824952 - protein, 520 aa, Homo sapiens
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 824953 - protein, 110 aa, Homo sapiens
MRLAEALVHGGSAQQAGGQAGGLAGRQDWDRGPENGAAGTREAWNGASAMSNKCDVVVVGGGISGPQPIGLDGAHYIESRFSSPSLPTPMPVSSGNTLTGTPRNNASPAI

SEQ ID NO: 824954 - protein, 520 aa, Homo sapiens; identical to SEQ ID NO: 824952

SEQ ID NO: 824955 - protein, 506 aa, Homo sapiens
MGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 824956 - protein, 520 aa, Homo sapiens; identical to SEQ ID NO: 824952

SEQ ID NO: 824957 - protein, 244 aa, Homo sapiens
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISFTPCHSYRWCPVVWVYSVLSCLTLLKCYSVYSLKSYCFVRCVSS

SEQ ID NO: 824958 - protein, 502 aa, Homo sapiens
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEAPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 824959 - protein, 474 aa, Homo sapiens
MSNKCDVVVVGGGISGMAAAKLLHDSGLNVVVLEARDRVGGRTYTLRGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 824960 - protein, 623 aa, Homo sapiens
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRVSVELVRRRLSPGGLALDLVYDQLTIKMDYGEELRSPITSLTPGESKTTSPSSPEEDVMLGSLTFSVDYNFPKKALVVTIQEAHGLSVMDARPRYLTLNQMTSF

SEQ ID NO: 824961 - protein, 260 aa, Homo sapiens
VVAAAAAERGGGGAEGGVSVSSGCLFGKWIRRCRSSPKGAADREASTDPARPRAPPPPAMARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILVGNKNDDPERKVVETEDAYKFAGQMGIQLFETSAKENVNVEEMFNCITELVLRAKKDNLAKQQQQQQNDVVKLTKNSKRKKRCC

SEQ ID NO: 824962 - protein, 260 aa, Homo sapiens; identical to SEQ ID NO: 824961

SEQ ID NO: 824963 - protein, 260 aa, Homo sapiens; identical to SEQ ID NO: 824961

SEQ ID NO: 824964 - protein, 260 aa, Homo sapiens; identical to SEQ ID NO: 824961

SEQ ID NO: 824965 - protein, 276 aa, Homo sapiens
MAPSPLQRLHCGPSPSPRPTEVPRGTVSVSCRYLKNSLHVFVSGGAIGTSSPALLECQEGVGPARPSLLVPPPPRPRRLDLARTLPAERTDSQSLYIVYIALPGRTPRPALAFAFLMPACCNRPSPRPSPAHLTASSVLRRQRHVLAASAASPCQWSGLRVAHSLRQVVSLCPRCTGSCPFSGACASSLPSPLSCPHSHSGSWGTWSQGRPCSSTEVAGLALWPTDFLSCLLDASELQTQGSHGFSFTPTGFSSNRKVGVGSCRDGAGRGAMGGLF

SEQ ID NO: 824966 - protein, 260 aa, Homo sapiens; identical to SEQ ID NO: 824961

SEQ ID NO: 824967 - protein, 260 aa, Homo sapiens; identical to SEQ ID NO: 824961

SEQ ID NO: 824968 - protein, 260 aa, Homo sapiens; identical to SEQ ID NO: 824961

SEQ ID NO: 824969 - protein, 260 aa, Homo sapiens; identical to SEQ ID NO: 824961

SEQ ID NO: 824970 - protein, 219 aa, Homo sapiens
VVAAAAAERGGGGAEGGVSVSSGCLFGKWIRRCRSSPKGAADREASTDPARPRAPPPPAMARDYDHLFKLLIIGDSGVGKSSLLLRFADNTFSGSYITTIGVDFKIRTVEINGEKVKLQIWDTAGQERFRTITSTAETALRSLPQPEAHGGSSGDSLSFVPLFKEFSPCFCIGRCHRHFLPRPPRVPRRCWTSPPFPTGAPSSPAKAPGPGEDAARRAD

SEQ ID NO: 824971 - protein, 182 aa, Homo sapiens
VVAAAAAERGGGGAEGGVSVSSGCLFGKWIRRCRSSPKGAADREASTDPARPRAPPPPAMARDYDHLFKLLRQVVSLCPRCTGSCPFSGACASSLPSPLSCPHSHSGSWGTWSQGRPCSSTEVAGLALWPTDFLSCLLDASELQTQGSHGFSFTPTGFSSNRKVGVGSCRDGAGRGAMGGLF

SEQ ID NO: 824972 - protein, 282 aa, Homo sapiens
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 824973 - protein, 282 aa, Homo sapiens; identical to SEQ ID NO: 824972

SEQ ID NO: 824974 - protein, 252 aa, Homo sapiens
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEDNEGQTALHYASACEFLDIVELLLQSGADPTLRDQDGCLPEEVTGCKTVSLVLQRHTTGKA

SEQ ID NO: 824975 - protein, 116 aa, Homo sapiens
MASSFLPAGAITGDSGGELSSGDDSGEVEFPHSPEIEETSCLAELFEKAAAHLQGLIQVASREQLLYLYARYKQSNWKLYTPNQASGFEETKWNLNTVINPPTIRYSIVNCSVDLD

SEQ ID NO: 824976 - protein, 282 aa, Homo sapiens; identical to SEQ ID NO: 824972

SEQ ID NO: 824977 - protein, 282 aa, Homo sapiens; identical to SEQ ID NO: 824972

SEQ ID NO: 824978 - protein, 282 aa, Homo sapiens; identical to SEQ ID NO: 824972

SEQ ID NO: 824979 - protein, 282 aa, Homo sapiens; identical to SEQ ID NO: 824972

SEQ ID NO: 824980 - protein, 255 aa, Homo sapiens
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQVPAQPQWARTPSGLLGCLIPCLGSWTALDQTSLG

SEQ ID NO: 824981 - protein, 255 aa, Homo sapiens; identical to SEQ ID NO: 824980

SEQ ID NO: 824982 - protein, 277 aa, Homo sapiens
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 824983 - protein, 277 aa, Homo sapiens; identical to SEQ ID NO: 824982

SEQ ID NO: 824984 - protein, 336 aa, Homo sapiens
MGQRPGPVLPAVAVLGQVAKRKVAWLLRWKAVTRTETAGNSSGVYGFGKMKIFVKYFQKMADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 824985 - protein, 148 aa, Homo sapiens
MYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 824986 - protein, 242 aa, Homo sapiens
MADPWQECMDYAVTLARQAGEVVCEAIKNEMNVMLKSSPVDLVTATDQKVEKMLISSIKEKYPSHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 824987 - protein, 277 aa, Homo sapiens; identical to SEQ ID NO: 824982

SEQ ID NO: 824988 - protein, 277 aa, Homo sapiens; identical to SEQ ID NO: 824982

SEQ ID NO: 824989 - protein, 277 aa, Homo sapiens; identical to SEQ ID NO: 824982

SEQ ID NO: 824990 - protein, 234 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKFTGDFT

SEQ ID NO: 824991 - protein, 225 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKKNPKKKGGGPQRGPPKKTPP

SEQ ID NO: 824992 - protein, 469 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITGTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATADIIIGHLCIQT

SEQ ID NO: 824993 - protein, 472 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITGTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIQT

SEQ ID NO: 824994 - protein, 204 aa, Homo sapiens
MSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIQT

SEQ ID NO: 824995 - protein, 488 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITGTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIQT

SEQ ID NO: 824996 - protein, 488 aa, Homo sapiens; identical to SEQ ID NO: 824995

SEQ ID NO: 824997 - protein, 488 aa, Homo sapiens; identical to SEQ ID NO: 824995

SEQ ID NO: 824998 - protein, 488 aa, Homo sapiens; identical to SEQ ID NO: 824995

SEQ ID NO: 824999 - protein, 488 aa, Homo sapiens; identical to SEQ ID NO: 824995

SEQ ID NO: 825000 - protein, 330 aa, Homo sapiens
MNKFIYEIARRHPFLYAPTILLWAARYDKIIPSCCKAENAVECFQTKAATVTKELRESSLLNQHACAVMKNFGTRTFQAITGTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIQT

SEQ ID NO: 825001 - protein, 356 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITGTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASGGG

SEQ ID NO: 825002 - protein, 488 aa, Homo sapiens; identical to SEQ ID NO: 824995

SEQ ID NO: 825003 - protein, 455 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825004 - protein, 438 aa, Homo sapiens
KARTGWCESAEVVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825005 - protein, 363 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825006 - protein, 455 aa, Homo sapiens; identical to SEQ ID NO: 825003

SEQ ID NO: 825007 - protein, 455 aa, Homo sapiens; identical to SEQ ID NO: 825003

SEQ ID NO: 825008 - protein, 414 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVYQGMGQPLSFILTPGALLGKTKIPDLPSFLLSLFMPSSSSILGSGASPLPHFAAEASSRTPAEDSIRARPHQCPVPGSQVRCYDP

SEQ ID NO: 825009 - protein, 414 aa, Homo sapiens; identical to SEQ ID NO: 825008

SEQ ID NO: 825010 - protein, 363 aa, Homo sapiens; identical to SEQ ID NO: 825005

SEQ ID NO: 825011 - protein, 410 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825012 - protein, 280 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSG

SEQ ID NO: 825013 - protein, 163 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEVGGEILEP

SEQ ID NO: 825014 - protein, 258 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDCVDEGSVQQK

SEQ ID NO: 825015 - protein, 156 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLENLARRFI

SEQ ID NO: 825016 - protein, 166 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDCVDEGSVQQK

SEQ ID NO: 825017 - protein, 500 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVYQGMGQPLSFILTPGALLGKTKIPDLPSFLLSYLCPLLPPSWAQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825018 - protein, 413 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSNREQAVGPPGVQQGLPLSSGRARRHGFCIAAAS

SEQ ID NO: 825019 - protein, 462 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSVLCPFAADADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825020 - protein, 320 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSGASPLPHFAAEASSRTPAEDSIRARPHQCPVPGSQVRCYDP

SEQ ID NO: 825021 - protein, 363 aa, Homo sapiens; identical to SEQ ID NO: 825005

SEQ ID NO: 825022 - protein, 417 aa, Homo sapiens
ASSVAPPPAPSSRPLVHFRLLPLPGPFSLVFPGLASPSPCARPEREVPEPRRGRVLGCRRCWPARPSRGSRHRLESFSCPRCVGRLESQENQMASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKDFVWMRARLQQEVEEQLKKKCFTLLCYYDPNSVLCPFAADADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 825023 - protein, 188 aa, Homo sapiens
MNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLGSWGLSQCRKGTPFYGQSKSG

SEQ ID NO: 825024 - protein, 420 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 825025 - protein, 570 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEGEAASPTATTYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 825026 - protein, 345 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 825027 - protein, 561 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 825028 - protein, 487 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQLRICDWTMNQNGRHLYPSTSEDTLGITWQSPGTWASLVPFQVSNRTPILPANVQNYGLNIIGEPFLQAETSN

SEQ ID NO: 825029 - protein, 168 aa, Homo sapiens
MNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 825030 - protein, 420 aa, Homo sapiens; identical to SEQ ID NO: 825024

SEQ ID NO: 825031 - protein, 387 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPGNHSSLLHF

SEQ ID NO: 825032 - protein, 200 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQGKNFFSSNKCIKI

SEQ ID NO: 825033 - protein, 420 aa, Homo sapiens; identical to SEQ ID NO: 825024

SEQ ID NO: 825034 - protein, 435 aa, Homo sapiens
MAGKTSDSSIKWQLCYDMSARTWWMDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 825035 - protein, 446 aa, Homo sapiens
TEKRNELWHRSCLLNSSTPIKKKKSHCVLCKMVLHSDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 825036 - protein, 243 aa, Homo sapiens
AQTVSVLLPLGCSRGLKESAASTEIPLPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 825037 - protein, 393 aa, Homo sapiens
AQTVSVLLPLGCSRGLKESAASTEIPLPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEGEAASPTATTYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 825038 - protein, 420 aa, Homo sapiens; identical to SEQ ID NO: 825024

SEQ ID NO: 825039 - protein, 440 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLGSWGLSQCRKGTPFYGQSKSG

SEQ ID NO: 825040 - protein, 117 aa, Homo sapiens
ELAAYKEEANTIAKSDLLQCLQYQFYQIGTCLLPEVTEEDQGRICVVIDLDETLVHSSFKPINNADFIVPIEIERTLLFGPRELFCLSCSISCRFPPSRCHLEGRGSASHCDWAMGF

SEQ ID NO: 825041 - protein, 1646 aa, Homo sapiens
SAALGASLAIPRPGLPGVHGRGPGTLSGRAMEGAEPRARPERLAEAETRAADGGRLVEVQLSGGAPWGFTLKGGREHGEPLVITKIEEGSKAAAVDKLLAGDEIVGINDIGLSGFRQEAICLVKGSHKTLKLVVKRRSELGWRPHSWHATKFSDSHPELAASPFTSTSGCPSWSGRHHASSSSHDLSSSWEQTNLQRTLDHFSSLGSVDSLDHPSSRLSVAKSNSSIDHLGSHSKRDSAYGSFSTSSSTPDHTLSKADTSSAENILYTVGLWEAPRQGGRQAQAAGDPQGSEEKLSCFPPRVPGDSGKGPRPEYNAEPKLAAPGRSNFGPVWYVPDKKKAPSSPPPPPPPLRSDSFAATKSHEKAQGPVFSEAAAAQHFTALAQAQPRGDRRPELTDRPWRSAHPGSLGKGSGGPGCPQEAHADGSWPPSKDGASSRLQASLSSSDVRFPQSPHSGRHPPLYSDHSPLCADSLGQEPGAASFQNDSPPQVRGLSSCDQKLGSGWQGPRPCVQGDLQAAQLWAGCWPSDTALGALESLPPPTVGQSPRHHLPQPEGPPDARETGRCYPLDKGAEGCSAGAQEPPRASRAEKASQRLAASITWADGESSRICPQETPLLHSLTQEGKRRPESSPEDSATRPPPFDAHVGKPTRRSDRFATTLRNEIQMHRAKLQKSRSTVALTAAGEAEDGTGRWRAGLGGGTQEGPLAGTYKDHLKEAQARVLRATSFKRRDLDPNPGDLYPESLEHRMGDPDTVPHFWEAGLAQPPSSTSGGPHPPRIGGRRRFTAEQKLKSYSEPEKMNEVGLTRGYSPHQHPRTSEDTVGTFADRWKFFEETSKPVPQRPAQKQALHGIPRDKPERPRTAGRTCEGTEPWSRTTSLGDSLNAHSAAEKAGTSDLPRRLGTFAEYQASWKEQRKPLEARSSGRCHSADDILDVSLDPQERPQHVHGRSRSSPSTDHYKQEASVELRRQAGDPGEPREELPSAVRAEEGQSTPRQADAQCREGSPGSQQHPPSQKAPNPPTFSELSHCRGAPELPREGRGRAGTLPRDYRYSEESTPADLGPRAQSPGSPLHARGQDSWPVSSALLSKRPAPQRPPPPKREPRRYRATDGAPADAPVGVLGRPFPTPSPASLDVYVARLSLSHSPSVFSSAQPQDTPKATVCERGSQHVSGDASRPLPEALLPPKQQHLRLQTATMETSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 825042 - protein, 1646 aa, Homo sapiens; identical to SEQ ID NO: 825041

SEQ ID NO: 825043 - protein, 1353 aa, Homo sapiens
SAALGASLAIPRPGLPGVHGRGPGTLSGRAMEGAEPRARPERLAEAETRAADGGRLVEVQLSGGAPWGFTLKGGREHGEPLVITKIEEGSKAAAVDKLLAGDEIVGINDIGLSGFRQEAICLVKGSHKTLKLVVKRRSELGWRPHSWHATKFSDSHPELAASPFTSTSGCPSWSGRHHASSSSHDLSSSWEQTNLQRTLDHFSSLGSVDSLDHPSSRLSVAKSNSSIDHLGSHSKRDSAYGSFSTSSSTPDHTLSKADTSSAENILYTVGLWEAPRQGGRQAQAAGDPQGSEEKLSCFPPRVPGDSGKGPRPEYNAEPKLAAPGRSNFGPVWYVPDKKKAPSSPPPPPPPLRSDSFAATKSHEKAQGPVFSEAAAAQHFTALAQAQPRGDRRPELTDRPWRSAHPGSLGKGSGGPGCPQEAHADGSWPPSKDGASSRLQASLSSSDVRFPQSPHSGRHPPLYSDHSPLCADSLGQEPGAASFQNDSPPQVRGLSSCDQKLGSGWQGPRPCVQGDLQAAQLWAGCWPSDTALGALESLPPPTVGQSPRHHLPQPEGPPDARETGRCYPLDKGAEGCSAGAQEPPRASRAEKASQRLAASITWADGESSRICPQETPLLHSLTQEGKRRPESSPEDSATRPPPFDAHVGKPTRRSDRFATTLRNEIQMHRAKLQKSRSTVALTAAGEAEDGTGRWRAGLGGGTQEGPLAGTYKDHLKEAQARVLRATSFKRRDLDPNPGDLYPESLEHRMGDPDTVPHFWEAGLAQPPSSTSGGPHPPRIGGRRRFTAEQKLKSYSEPEKMNEVGLTRGYSPHQHPRTSEDTVGTFADRWKFFEETSKPVPQRPAQKQALHGIPRDKPERPRTAGRTCEGTEPWSRTTSLGDSLNAHSAAEKAGTSDLPRRLGTFAEYQASWKEQRKPLEARSSGRCHSADDILDVSLDPQERPQHVHGRSRSSPSTDHYKQEASVELRRQAGDPGEPREELPSAVRAEEGQSTPRQADAQCREGSPGSQQHPPSQKAPNPPTFSELSHCRGAPELPREGRGRAGTLPRDYRYSEESTPADLGPRAQSPGSPLHARGQDSWPVSSALLSKRPAPQRPPPPKREPRRYRATDGAPADAPVGVLGRPFPTPSPASLDVYVARLSLSHSPSVFSSAQPQDTPKATVCERGSQHVSGDASRPLPEALLPPKQQHLRLQTATMETSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKHIEPAVLSVPLFASETSG

SEQ ID NO: 825044 - protein, 679 aa, Homo sapiens
ESCSRGGLWVPEAHRCLHSWANSHPARQADAQCREGSPGSQQHPPSQKAPNPPTFSELSHCRGAPELPREGRGRAGTLPRDYRYSEESTPADLGPRAQSPGSPLHARGQDSWPVSSALLSKRPAPQRPPPPKREPRRYRATDGAPADAPVGVLGRPFPTPSPASLDVYVARLSLSHSPSVFSSAQPQDTPKATVCERGSQHVSGDASRPLPEALLPPKQQHLRLQTATMETSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 825045 - protein, 1191 aa, Homo sapiens
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTSLYEIPAVSSSSFFEEFGKLLREADEMDSIHDVTFQVGNRLFPAHKYILAVHSDFFQKLFLSDGNTSEFTDIYQKDEDSAGCHLFVVEKVHPDMFEYLLQFIYTDTCDFLTHGFKPRIHLNKNPEEYQGTLNSHLNKVNFHEDDNQKSAFEVYKSNQAQTVSERQKSKPKSCKKGKNIREDDPVRMLQTVAKKFDFSNLSSRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTGLLKSGKTNSVESLPELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNA

SEQ ID NO: 825046 - protein, 1353 aa, Homo sapiens
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTSLYEIPAVSSSSFFEEFGKLLREADEMDSIHDVTFQVGNRLFPAHKYILAVHSDFFQKLFLSDGNTSEFTDIYQKDEDSAGCHLFVVEKVHPDMFEYLLQFIYTDTCDFLTHGFKPRIHLNKNPEEYQGTLNSHLNKVNFHEDDNQKSAFEVYKSNQAQTVSERQKSKPKSCKKGKNIREDDPVRMLQTVAKKFDFSNLSSRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTGLLKSGKTNSVESLPELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 825047 - protein, 1249 aa, Homo sapiens
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTSLYEIPAVSSSSFFEEFGKLLREADEMDSIHDVTFQVGNRLFPAHKYILAVHSDFFQKLFLSDGNTSEFTDIYQKDEDSAGCHLFVVEKVHPDMFEYLLQFIYTDTCDFLTHGFKPRIHLNKNPEEYQGTLNSHLNKVNFHEDDNQKSAFEVYKSNQAQTVSERQKSKPKSCKKGKNIREDDPVRMLQTVAKKFDFSNLSSRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTGLLKSGKTNSVESLPELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVSFVGGERR

SEQ ID NO: 825048 - protein, 1353 aa, Homo sapiens; identical to SEQ ID NO: 825046

SEQ ID NO: 825049 - protein, 345 aa, Homo sapiens
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCFAENPQMEEKHVVAASSYRYSRPFHPSQG

SEQ ID NO: 825050 - protein, 203 aa, Homo sapiens
MLIDIISRKMIALTTKENNSGMNSMETVLFTPSKAPKPVNAWASSLHSVSSKSFRDFLLEEKKSVTSHSSGDHVKKVSFKGIENSQAPKIVRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 825051 - protein, 1353 aa, Homo sapiens; identical to SEQ ID NO: 825046

SEQ ID NO: 825052 - protein, 1353 aa, Homo sapiens; identical to SEQ ID NO: 825046

SEQ ID NO: 825053 - protein, 132 aa, Homo sapiens
PLPPGFKRFSCLRHPSSWDYRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 825054 - protein, 156 aa, Homo sapiens
MARTRLTAVSDLAGLRATGGRRRQSTCLNQAYKTPKMGALYQAGAQQMSAEKMMQGAVLTQVTMCDRKAVIKNADMSEEMQQDSVECATQALEKYNIEKDIAAHIKKEFDKKYNPTWALPSWGRNFGSYVTHGNPNTFIYFLPLGQVAHFFLFKSG

SEQ ID NO: 825055 - protein, 130 aa, Homo sapiens
MRQCSVNRGVASMAGLGLMIALIPPQDTVGSRTICFYYGYTMFDRNAYDATECGEQDSVECATQALEKYNIEKDIAAHIKKEFDKKYNPTWALPSWGRNFGSYVTHGNPNTFIYFLPLGQVAHFFLFKSG

SEQ ID NO: 825056 - protein, 90 aa, Homo sapiens
MCDRKAVIKNADMSEEMQQDSVECATQALEKYNIEKDIAAHIKKEFDKKYNPTWALPSWGRNFGSYVTHGNPNTFIYFLPLGLSLPGYRA

SEQ ID NO: 825057 - protein, 120 aa, Homo sapiens
MGALYQAGAQQMSAEKMMQGAVLTQVTMCDRKAVIKNADMSEEMQQDSVECATQALEKYNIEKDIAAHIKKEFDKKYNPTWALPSWGRNFGSYVTHGNPNTFIYFLPLGQVAHFFLFKSG

SEQ ID NO: 825058 - protein, 124 aa, Homo sapiens
MCDRKAVIKNADMSEEMQQDSVECATQALEKYNIEKDIAAHIKKEFDKKYNPTWALPSWGRNFGSYVTHGNPNTFIYFLPLGPPLPSFGGGGGGAPPPPKKKASGPFLSVQIWLKAWDCAHTPQ

SEQ ID NO: 825059 - protein, 110 aa, Homo sapiens
MCDRKAVIKNADMSEEMQQDSVECATQALEKYNIEKDIAAHIKKEFDKKYNPTWALPSWGRNFGSYVTHGNPNTFQFFKPFFFFPFVLKNPPPLFWGGGGALSGHSVQIW

SEQ ID NO: 825060 - protein, 247 aa, Homo sapiens
ICCCLLLDNIHSYLPASVYLRLQICTENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYRSKLILFPRKPSAPKKGDSSAEELKLATQLTGPVMPVRNVYKKEKARVITEEEKNFKAFASLRMARANARLFGIRAKRAKEAAEQDVDHEQT

SEQ ID NO: 825061 - protein, 875 aa, Homo sapiens
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825062 - protein, 727 aa, Homo sapiens
MSVYQSSCFHLSDIDVGTTAEVIERLLPNKVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825063 - protein, 683 aa, Homo sapiens
MTLITIKHLTAHGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825064 - protein, 644 aa, Homo sapiens
LLCMFSFTEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825065 - protein, 319 aa, Homo sapiens
ICCCLLLDNIHSYLPASVYLRLQICTENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825066 - protein, 886 aa, Homo sapiens
MHDAFEPVPILEKLPLQIDCLAAWEEWLLVGTKQGHLLLYRIRKDVVPADVASPESGSCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825067 - protein, 886 aa, Homo sapiens; identical to SEQ ID NO: 825066

SEQ ID NO: 825068 - protein, 886 aa, Homo sapiens; identical to SEQ ID NO: 825066

SEQ ID NO: 825069 - protein, 463 aa, Homo sapiens
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSLDSRNLTCHVCPAFLASCACYLPFSQTVFEAIE

SEQ ID NO: 825070 - protein, 107 aa, Homo sapiens
AVCFLLLVLHSWPFSLEQAWPGKGGAPQEAVSTELLLFLQTNVALVAPLLRLENNHCHIEESEHVLKKAHKYSELIILYEKKGLHEKGVGVVPWIWEGLLYMAGETH

SEQ ID NO: 825071 - protein, 96 aa, Homo sapiens
LTSRKSGVDDGCVVEGPVAGGFLAGSRSTLSPDSFRTPARPGTLWARRRWQLSPCRHARRFRASADPRKAASANRLSGCLGGMASCGNQTRTSSSL

SEQ ID NO: 825072 - protein, 886 aa, Homo sapiens; identical to SEQ ID NO: 825066

SEQ ID NO: 825073 - protein, 886 aa, Homo sapiens; identical to SEQ ID NO: 825066

SEQ ID NO: 825074 - protein, 658 aa, Homo sapiens
KGVIKPRRDVSLNRNETYQLAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 825075 - protein, 886 aa, Homo sapiens; identical to SEQ ID NO: 825066

SEQ ID NO: 825076 - protein, 886 aa, Homo sapiens; identical to SEQ ID NO: 825066

SEQ ID NO: 825077 - protein, 96 aa, Homo sapiens
SGEMCQQKRSNYPASARAPHETRQRPSAGNTQGMSGPGTDNGVLPSVPERCLGTAEGTRGARTAGRWFKNNSPPNLWSSVGHPARGAQAGVSGTAG

SEQ ID NO: 825078 - protein, 781 aa, Homo sapiens
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLL

SEQ ID NO: 825079 - protein, 367 aa, Homo sapiens
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTGNKW

SEQ ID NO: 825080 - protein, 353 aa, Homo sapiens
ARSRRPAPNRPALGICGGLRRGSRAEPVSSSERQGRGACGAAMEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 825081 - protein, 353 aa, Homo sapiens; identical to SEQ ID NO: 825080

SEQ ID NO: 825082 - protein, 290 aa, Homo sapiens
ARSRRPAPNRPALGICGGLRRGSRAEPVSSSERQGRGACGAAMEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 825083 - protein, 200 aa, Homo sapiens
ARSRRPAPNRPALGICGGLRRGSRAEPVSSSERQGRGACGAAMEATRRRQHLGATGGPGAQLGASFLQARYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 825084 - protein, 353 aa, Homo sapiens; identical to SEQ ID NO: 825080

SEQ ID NO: 825085 - protein, 353 aa, Homo sapiens; identical to SEQ ID NO: 825080

SEQ ID NO: 825086 - protein, 290 aa, Homo sapiens; identical to SEQ ID NO: 825082

SEQ ID NO: 825087 - protein, 362 aa, Homo sapiens
ARSRRPAPNRPALGICGGLRRGSRAEPVSSSERQGRGACGAAMEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLVEATSCSLPIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 825088 - protein, 342 aa, Homo sapiens
ARSRRPAPNRPALGICGGLRRGSRAEPVSSSERQGRGGGGAGGGGGGGRGGGGGGGGGGGGGGGGGGGGGRGGGGGGEGAPWEGEGGGGGERGEGGGGGGGGQGGGRGGGGGGREAEGGGGVGEGVGEGGGGRGEGEEGGGGGAEGEVRGEHAGGGAGGGGEGVNHRAGGSGYQHHLSVRENPIIKNLKPETLIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 825089 - protein, 353 aa, Homo sapiens; identical to SEQ ID NO: 825080

SEQ ID NO: 825090 - protein, 353 aa, Homo sapiens; identical to SEQ ID NO: 825080

SEQ ID NO: 825091 - protein, 1198 aa, Homo sapiens
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHRPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVDDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 825092 - protein, 182 aa, Homo sapiens
PLQIEVVNTFKSGASFQGALRRQSSVTSQSQDVANLSSPSRVSLSNALFLSDQPSSCCSRAGLENPGHRVQQERVKLKEIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 825093 - protein, 119 aa, Homo sapiens
MKTTKGKKAGLLISVLIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 825094 - protein, 1243 aa, Homo sapiens
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHRPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKGVKKGDGLQLPAADGAAASNAADSANASLVNGKMQDGNVDASQSKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVDDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 825095 - protein, 1198 aa, Homo sapiens; identical to SEQ ID NO: 825091

SEQ ID NO: 825096 - protein, 125 aa, Homo sapiens
MRIPDDGGTDPVLPRLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 825097 - protein, 104 aa, Homo sapiens
SRDLVYRFLPPPPLPAPVLRPLLKHLAQPSALRALIFPPCSGWCHRRLCGPRSASNGCVDVPFSWSYSTPPQECLPSARTKTEETAILMDSQANYEVETKKVIT

SEQ ID NO: 825098 - protein, 483 aa, Homo sapiens
GGRGEGGGKSAALPLAAGSLAAPGGGGGSAGGARPGDSHSPVPPPPHAAWTMDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 825099 - protein, 457 aa, Homo sapiens
AEWLKGQNAGVFSVSQTSSAAGDWGAQEAAFRFALSHPSSSKQFILSPGGDSPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 825100 - protein, 418 aa, Homo sapiens
GAAGREAGRARHFRWPLARWPLLEAAAGAQGARGPGTRIPRFPLHPTRPGPWTPGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 825101 - protein, 483 aa, Homo sapiens; identical to SEQ ID NO: 825098

SEQ ID NO: 825102 - protein, 357 aa, Homo sapiens
GGRGEGGGKSAALPLAAGSLAAPGGGGGSAGGARPGDSHSPVPPPPHAAWTMDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSKACGNDPN

SEQ ID NO: 825103 - protein, 483 aa, Homo sapiens; identical to SEQ ID NO: 825098

SEQ ID NO: 825104 - protein, 339 aa, Homo sapiens
MLLAMPALWYLATSWCSTSGGRTTWRPVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 825105 - protein, 484 aa, Homo sapiens
GGRGEGGGKSAALPLAAGSLAAPGGGGGSAGGARPGDSHSPVPPPPHAAWTMDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKGD

SEQ ID NO: 825106 - protein, 439 aa, Homo sapiens
GGRGEGGGKSAALPLAAGSLAAPGGGGGSAGGARPGDSHSPVPPPPHAAWTMDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTLHHPVQRGDCGWTWPHLRLV

SEQ ID NO: 825107 - protein, 174 aa, Homo sapiens
PPGHVTAAPQHGGRVGSRLLGRRPAYRCPEPAGMGAAAWFCAPWGASGGGAGDPDVPDRGGECGGRGASSDLSSRLALEGTEETCVARGADPPPGREEALPGQRRRTPSPRERERERLFVRAGAAAEGAGRRLRALLQCGPLWRAEGMRSCALILMSAFLTDGGQWWCWLRSPP

SEQ ID NO: 825108 - protein, 251 aa, Homo sapiens
MRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 825109 - protein, 218 aa, Homo sapiens
MRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIVQS

SEQ ID NO: 825110 - protein, 293 aa, Homo sapiens
MTQQPLRGVTSLRFNQDQSCFCCAMETGVRIYNVEPLMEKGHLDHEQVGSMGLVEMLHRSNLLALVGGGSSPKFSEISGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 825111 - protein, 251 aa, Homo sapiens; identical to SEQ ID NO: 825108

SEQ ID NO: 825112 - protein, 251 aa, Homo sapiens; identical to SEQ ID NO: 825108

SEQ ID NO: 825113 - protein, 251 aa, Homo sapiens; identical to SEQ ID NO: 825108

SEQ ID NO: 825114 - protein, 251 aa, Homo sapiens; identical to SEQ ID NO: 825108

SEQ ID NO: 825115 - protein, 279 aa, Homo sapiens
MRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSAREYPLPTLPCPCPPAHLPYLGLASAACRLARVGKVGPMIGQYVDSQWSLASFTVPAESACICAFGRNTSKNVNSVIVVSGNSPLVGGTAWGKGLQVGPERILGPCEAQLHHQ

SEQ ID NO: 825116 - protein, 251 aa, Homo sapiens; identical to SEQ ID NO: 825108

SEQ ID NO: 825117 - protein, 251 aa, Homo sapiens
MRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIVVSGNSPLVGGTAWGKGLQVGPERILGPCEAQLHHQ

SEQ ID NO: 825118 - protein, 221 aa, Homo sapiens
MRHDKIVIVLKNRIYVYSFPDNPRKLFEFDTRDNPKGLCDLCPSLEKQLLVFPGHKCGSLQLVPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 825119 - protein, 172 aa, Homo sapiens [sequence omitted]

SEQ ID NO: 825120 - protein, 172 aa, Homo sapiens [sequence omitted]

SEQ ID NO: 825121 - protein, 144 aa, Homo sapiens
IFALKDMDSTLITGSAEEGGVVAEVNAVEGGRVSCLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 825122 - protein, 43 aa, Homo sapiens
MRLVLGEGRGIPDRVLEWRCKKGVLKVGAVQRITLRQSCPKKE

SEQ ID NO: 825123 - protein, 251 aa, Homo sapiens; identical to SEQ ID NO: 825108

SEQ ID NO: 825124 - protein, 217 aa, Homo sapiens
MRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACISLRSRSVLHVMDTIFSL

SEQ ID NO: 825125 - protein, 251 aa, Homo sapiens; identical to SEQ ID NO: 825108

SEQ ID NO: 825126 - protein, 251 aa, Homo sapiens; identical to SEQ ID NO: 825108

SEQ ID NO: 825127 - protein, 251 aa, Homo sapiens; identical to SEQ ID NO: 825108

SEQ ID NO: 825128 - protein, 218 aa, Homo sapiens; identical to SEQ ID NO: 825109

SEQ ID NO: 825129 - protein, 262 aa, Homo sapiens
MRHDKIVIVLKNRIYVYSFPDNPRKLFEFDTRDNPKAAHPTPHLHTLGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 825130 - protein, 218 aa, Homo sapiens; identical to SEQ ID NO: 825109

SEQ ID NO: 825131 - protein, 279 aa, Homo sapiens
MRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSAREYPLPTLPCPCPPAHLPYLGLASAACRLARVGKVGPMIGQYVDSQWSLASFTVPAESACICAFGRNTSKNVNSVIAICVDGTFHKYVFTPDGNCNREAFDVYLDICDDDDF

SEQ ID NO: 825132 - protein, 172 aa, Homo sapiens [sequence omitted]

SEQ ID NO: 825133 - protein, 172 aa, Homo sapiens [sequence omitted]

SEQ ID NO: 825134 - protein, 211 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 825135 - protein, 128 aa, Homo sapiens [sequence omitted]

SEQ ID NO: 825136 - protein, 211 aa, Homo sapiens; identical to SEQ ID NO: 825134

SEQ ID NO: 825137 - protein, 211 aa, Homo sapiens; identical to SEQ ID NO: 825134

SEQ ID NO: 825138 - protein, 211 aa, Homo sapiens; identical to SEQ ID NO: 825134

SEQ ID NO: 825139 - protein, 123 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVWLF

SEQ ID NO: 825140 - protein, 211 aa, Homo sapiens; identical to SEQ ID NO: 825134

SEQ ID NO: 825141 - protein, 817 aa, Homo sapiens
RRESAGKAARQADRGVSPKPICRRLKGPEEIARLLSWGFFTLIFVRLAGLKNLAEALGLGSPQEDEPSLAEAGAAPESLCEMKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 825142 - protein, 309 aa, Homo sapiens
RRESAGKAARQADRGVSPKPICRRLKGPEEIARLLSWGFFTLIFVRLAGLKNLAEALGLGNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTVSLPQDPEPLWE

SEQ ID NO: 825143 - protein, 252 aa, Homo sapiens
RRESAGKAARQADRGVSPKPICRRLKGPEEIARLLSWGFFTLIFVRLAGLKNLAEALGLGSPQEDEPSLAEAGAAPESLCEMKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCKSGDQETWVHKGQSGQSPVQALTMNVSEICRD

SEQ ID NO: 825144 - protein, 740 aa, Homo sapiens
RRESAGKAARQADRGVSPKPICRRLKGPEEIARLLSWGFFTLIFVRLAGLKNLAEALGLGSPQEDEPSLAEAGAAPESLCEMKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTVSLPQDPEPLWE

SEQ ID NO: 825145 - protein, 388 aa, Homo sapiens
RRESAGKAARQADRGVSPKPICRRLKGPEEIARLLSWGFFTLIFVRLAGLKNLAEALGLGSPQEDEPSLAEAGAAPESLCEMKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKQRQGFTVLARTVSIF

SEQ ID NO: 825146 - protein, 179 aa, Homo sapiens
MQRQNFRPPTPPYPGPGGGGWGSGSSFRGTPGGGGPRPPSPRDGYGSPHHTPPYGPRSRPYGSSHSPRHGGSFPGGRFGSPSPGGYPGSYSRSPAGSQQQFGYSPGQQQTHPQGSPRTSTPFGSGRVREKRMSNELENYFKPSMLEDPWAGLEPVSVVDISQQYSNTQTFTGKKGRYFC

SEQ ID NO: 825147 - protein, 179 aa, Homo sapiens; identical to SEQ ID NO: 825146

SEQ ID NO: 825148 - protein, 227 aa, Homo sapiens
MDNARMNSFLEYPILSSGDSGTCSARAYPSDHRITTFQSCAVSANSCGGDDRFLVGRGVQIGSPHHHHHHHHHHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGQSCWLVDAP

SEQ ID NO: 825149 - protein, 128 aa, Homo sapiens [sequence omitted]

SEQ ID NO: 825150 - protein, 335 aa, Homo sapiens
MDNARMNSFLEYPILSSGDSGTCSARAYPSDHRITTFQSCAVSANSCGGDDRFLVGRGVQIGSPHHHHHHHHHHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGKVGEYGYLGQPNAVRTNFTTKQLTELEKEFHFNKYLTRARRVEIAASLQLNETQVKIWFQNRRMKQKKREKEGLLPISPATPPGNDEKAEESSEKSSSSPCVPSPGSSTSDTLTTSH

SEQ ID NO: 825151 - protein, 103 aa, Homo sapiens
MCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 825152 - protein, 103 aa, Homo sapiens; identical to SEQ ID NO: 825151

SEQ ID NO: 825153 - protein, 103 aa, Homo sapiens; identical to SEQ ID NO: 825151

SEQ ID NO: 825154 - protein, 173 aa, Homo sapiens
MQRKLKVTSLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 825155 - protein, 103 aa, Homo sapiens; identical to SEQ ID NO: 825151

SEQ ID NO: 825156 - protein, 173 aa, Homo sapiens; identical to SEQ ID NO: 825154

SEQ ID NO: 825157 - protein, 235 aa, Homo sapiens
MAATGANAEKAESHNDCPVRLLNPNIAKMKEDILYHFNLTTSRHNFPALFGDVKFVCVGGSPSRMKAFIRCLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 825158 - protein, 103 aa, Homo sapiens; identical to SEQ ID NO: 825151

SEQ ID NO: 825159 - protein, 103 aa, Homo sapiens; identical to SEQ ID NO: 825151

SEQ ID NO: 825160 - protein, 103 aa, Homo sapiens; identical to SEQ ID NO: 825151

SEQ ID NO: 825161 - protein, 183 aa, Homo sapiens
MAATGANAEKAESHNDCPVRLLNPNIAKMKEDILYHFNLTTSRHNFPALFGDVKLCVCWWRDRQDERKYKVRKEQTGERSERRNKREQLRREENSKSKEIKTDPEEDTKATEQSINRQHKTEDKRQYRRRTHTGSYTPTTIKRNRTNRPRQRQETETREQNKPQRRRRSTDTKEQKAETTDKN

SEQ ID NO: 825162 - protein, 103 aa, Homo sapiens; identical to SEQ ID NO: 825151

SEQ ID NO: 825163 - protein, 103 aa, Homo sapiens; identical to SEQ ID NO: 825151

SEQ ID NO: 825164 - protein, 103 aa, Homo sapiens; identical to SEQ ID NO: 825151

SEQ ID NO: 825165 - protein, 173 aa, Homo sapiens; identical to SEQ ID NO: 825154

SEQ ID NO: 825166 - protein, 173 aa, Homo sapiens; identical to SEQ ID NO: 825154

SEQ ID NO: 825167 - protein, 181 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGPGARPGVLNRAGVVPAQASLEAIARGPAPGRAYRS

SEQ ID NO: 825168 - protein, 171 aa, Homo sapiens
MKAFIRCLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 825169 - protein, 246 aa, Homo sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 825170 - protein, 246 aa, Homo sapiens; identical to SEQ ID NO: 825169

SEQ ID NO: 825171 - protein, 127 aa, Homo sapiens [sequence omitted]

SEQ ID NO: 825172 - protein, 246 aa, Homo sapiens; identical to SEQ ID NO: 825169

SEQ ID NO: 825173 - protein, 246 aa, Homo sapiens; identical to SEQ ID NO: 825169

SEQ ID NO: 825174 - protein, 214 aa, Homo sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKEKLKTVKENWKNLSDSEKELYIQHAKEDETRYHNEMKSWEEQMIEVGRKDLLRRTIKKQRKYGAEEC

SEQ ID NO: 825175 - protein, 120 aa, Homo sapiens [sequence omitted]

SEQ ID NO: 825176 - protein, 237 aa, Homo sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKEVSITVVSLKCLLRISVRECIRARLDSCEDNLVLLIIQVF

SEQ ID NO: 825177 - protein, 146 aa, Homo sapiens
GGASASLAPGSARAGLLSAAAHRRPVVRGAGTRRRRRRWRLCVAGAEARRPVPVAGERAGGGAMWFMYLLSWLSLFIQVAFITLAVGETARPRPARAPAPASVLVGGRIAGVSEPLGGPLPGAPGLRRPNPFPPDPAPPVEPGSPA

SEQ ID NO: 825178 - protein, 259 aa, Homo sapiens
GGASASLAPGSARAGLLSAAAHRRPVVRGAGTRRRRRRWRLCVAGAEARRPVPVAGERAGGGAMWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 825179 - protein, 114 aa, Homo sapiens
GGASASLAPGSARAGLLSAAAHRRPVVRGAGTRRRRRRWRLCVAGAEARRPVPVAGERAGGGAMWFMYLLSWLSLFIQVAFITLAVAAGLYYLAELIEEYTVATSRIIKYMIWD

SEQ ID NO: 825180 - protein, 259 aa, Homo sapiens; identical to SEQ ID NO: 825178

SEQ ID NO: 825181 - protein, 259 aa, Homo sapiens; identical to SEQ ID NO: 825178

SEQ ID NO: 825182 - protein, 259 aa, Homo sapiens; identical to SEQ ID NO: 825178

SEQ ID NO: 825183 - protein, 259 aa, Homo sapiens; identical to SEQ ID NO: 825178

SEQ ID NO: 825184 - protein, 259 aa, Homo sapiens; identical to SEQ ID NO: 825178

SEQ ID NO: 825185 - protein, 96 aa, Homo sapiens
YLTEVGEGYEFFVSFCVRAQTAANRVVIAPKHSVRVWISGLFSARGWKRMSKKIPATTIVLKRIALIRLSLTPYTALPGMLEAAVHAPGNSDVTRT

SEQ ID NO: 825186 - protein, 259 aa, Homo sapiens; identical to SEQ ID NO: 825178

SEQ ID NO: 825187 - protein, 69 aa, Homo sapiens
PPPRLRTANRCGSHSSRACRAELFPNAYRRLCASGPSCSLLSPPLTLLLWLVPIRPQLRCHLFREVHRG

SEQ ID NO: 825188 - protein, 149 aa, Homo sapiens
MIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 825189 - protein, 259 aa, Homo sapiens; identical to SEQ ID NO: 825178

SEQ ID NO: 825190 - protein, 259 aa, Homo sapiens; identical to SEQ ID NO: 825178

SEQ ID NO: 825191 - protein, 259 aa, Homo sapiens; identical to SEQ ID NO: 825178

SEQ ID NO: 825192 - protein, 259 aa, Homo sapiens; identical to SEQ ID NO: 825178

SEQ ID NO: 825193 - protein, 259 aa, Homo sapiens; identical to SEQ ID NO: 825178

SEQ ID NO: 825194 - protein, 259 aa, Homo sapiens; identical to SEQ ID NO: 825178

SEQ ID NO: 825195 - protein, 103 aa, Homo sapiens
MGQQSSVRRLKRSVPCESNEANEANEANKTMPETPTGDSDPQPAPKKMKTSESSTILVVRYRRNVKRTSPEELLNDHARENRINPDQMEEEEFIEITTERPKK

SEQ ID NO: 825196 - protein, 245 aa, Homo sapiens
RPGRGRAGPPLAAAARRGRRLHVGRLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGVRTGNPCPAQLAT

SEQ ID NO: 825197 - protein, 2671 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825198 - protein, 2677 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELLVVCRLRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825199 - protein, 2338 aa, Homo sapiens
THRSQYEMICCVSETKDSSSLTRSLPRKLFADLETGPTDLTRKPTLSVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825200 - protein, 2695 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEVGLWAAGAGVGACAGRDHVLCVLQIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825201 - protein, 2253 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTADQQDRVCGELRGQPWHLHPGL

SEQ ID NO: 825202 - protein, 1654 aa, Homo sapiens
EPQLCHPQPAAPEPAEAIFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825203 - protein, 839 aa, Homo sapiens
PVRSTEPSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825204 - protein, 248 aa, Homo sapiens
EAGGNRPRLCLRLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825205 - protein, 2596 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKV

SEQ ID NO: 825206 - protein, 2492 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDVSTPAH

SEQ ID NO: 825207 - protein, 2493 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGRSAHIFGGLQREPLES

SEQ ID NO: 825208 - protein, 2117 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKQHSRGGGRGYLFHAQPQQQAAVTDAQVLSASTGGGGRPPGLL

SEQ ID NO: 825209 - protein, 1223 aa, Homo sapiens [sequence omitted]

SEQ ID NO: 825210 - protein, 1036 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMTDQSGCTNRRDPL

SEQ ID NO: 825211 - protein, 815 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPISNNVKIK

SEQ ID NO: 825212 - protein, 180 aa, Homo sapiens
MTWAASHMRTASQSTPPPKVRGLRQRHGVTGIPGEDVQGGGQGGGQLQPHQVSPTGRVASFSIPGSSSRYSLGPSLRRGHEVSERVQSSEMGTSVLIMQPILRFLQLLCENHNRDLQVSASPHTCPFPRWPAGMQTRQCGWCPSMAGVPCPGHCCFVAGGSPTPAAHKIVLPRPASLSVL

SEQ ID NO: 825213 - protein, 128 aa, Homo sapiens
SVRFFQPLPLYLQRGTGVGKGWEKELQAGVFSREGPEPQDESFPSPPTCPTTDCLFKVCPMNRYSAQKQYWKAKQTKQDKEKIADVVLLQKLQVCVCVQACICAHVPGTWVHKQRCCLSEPVGALWLS

SEQ ID NO: 825214 - protein, 2671 aa, Homo sapiens; identical to SEQ ID NO: 825197

SEQ ID NO: 825215 - protein, 2714 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQVWGAWGLDMPSFASLPFWRRWALSWALKAEEGVKEERPEQWLEKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825216 - protein, 2604 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825217 - protein, 2596 aa, Homo sapiens; identical to SEQ ID NO: 825205

SEQ ID NO: 825218 - protein, 1792 aa, Homo sapiens
MHPLPPSSDQGPLCTASTTSLATSSASPSTGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825219 - protein, 562 aa, Homo sapiens
APGESAEDENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 825220 - protein, 2661 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLKPSVAWFPLLRHLLLELVELGTEVGHQLHGGG

SEQ ID NO: 825221 - protein, 140 aa, Homo sapiens [sequence omitted]

SEQ ID NO: 825222 - protein, 2310 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNANKIVFVVSLRAPRMLSVGPM

SEQ ID NO: 825223 - protein, 1898 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQVWGAWGLDMPSFASLPFWRRWALSWALKAEEGVKEERPEQWLEKSFHNLMMSDKKSERFFKVLHDRMKRAQQETKSTVAVNMNDLGSQPHEDREPVDPTTKASPAQSLSYSPTDLHPHYYSAKKLNYDG

SEQ ID NO: 825224 - protein, 1198 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERAVLDVQCVGETMRKLTATDH

SEQ ID NO: 825225 - protein, 399 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVENVMVWTVGVCRHSVERKGEVLLIPQNGFWTLEMFGNPYRALSSPERILPLKESLCRVGVFLDYEAGDVSFYNMRDRSHIYTCPRSAFTVPVRPFFRLGSDDSPIFICPALT

SEQ ID NO: 825226 - protein, 105 aa, Homo sapiens
MVASEGSVSPPMPILIGPWFLDLGLPRVGAWAAAAGSVTSCRHTRRLWCSCCSLPHASSSVRGYSSSTRAPWRPASGPSPWWVSVPGHWPAPNHSSCRSQWGRLP

SEQ ID NO: 825227 - protein, 1265 aa, Homo sapiens
REATPPLRGLPAPPRHAPFPAGRFEPPRTKQGGRGSHTPWVYVINDLGIEENLKNDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNVSAANLSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQVPSIGLYRC

SEQ ID NO: 825228 - protein, 1153 aa, Homo sapiens
MTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 825229 - protein, 1381 aa, Homo sapiens
MASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYESSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 825230 - protein, 1271 aa, Homo sapiens
MASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIV

SEQ ID NO: 825231 - protein, 1399 aa, Homo sapiens
MASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 825232 - protein, 1034 aa, Homo sapiens
MASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTQRPEDSDHL

SEQ ID NO: 825233 - protein, 271 aa, Homo sapiens
WFMKMEWMALHAHTNHAVFAQLYSPLRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 825234 - protein, 575 aa, Homo sapiens
MASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLERG

SEQ ID NO: 825235 - protein, 1399 aa, Homo sapiens; identical to SEQ ID NO: 825231

SEQ ID NO: 825236 - protein, 1349 aa, Homo sapiens
MASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 825237 - protein, 522 aa, Homo sapiens [sequence omitted]

SEQ ID NO: 825238 - protein, 1399 aa, Homo sapiens; identical to SEQ ID NO: 825231

SEQ ID NO: 825239 - protein, 1033 aa, Homo sapiens [sequence omitted]

SEQ ID NO: 825240 - protein, 146 aa, Homo sapiens
MFSMVLADTVQVGEGQAGAFRQLTWAALPFQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 825241 - protein, 333 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 825242 - protein, 109 aa, Homo sapiens
MPLGLGRRKKAPPLVENEEAEPGRGGLGVGEPGPLGGGGSGGRGNGHARGSGAYWDPARHGARRRRRPGGHRQHDWVVPRDRHQRKHQGRVGRNWHHGLAQRGTMYYRA

SEQ ID NO: 825243 - protein, 196 aa, Homo sapiens
STDVGLNVAGSLHQSQEESLQLPGNGLAEEAAARASTDVEVFKSEDALGLTITDNGAGYAFIKRIKEGSVIDHIHLISVGDMIEAINGQSLLGCRHYEVARLLKELPRGRTFTLKPDAVCAHGLCCEDCQLKPAGTACRDSSNSCDLPEFCTGVSPHWPANVYLHDGHSCQDVGRILLQWHLPDSRAAVAVHIRSV

SEQ ID NO: 825244 - protein, 333 aa, Homo sapiens; identical to SEQ ID NO: 825241

SEQ ID NO: 825245 - protein, 333 aa, Homo sapiens; identical to SEQ ID NO: 825241

SEQ ID NO: 825246 - protein, 236 aa, Homo sapiens
MFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 825247 - protein, 201 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 825248 - protein, 128 aa, Homo sapiens
KRRRTQAAGDSGWDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 825249 - protein, 103 aa, Homo sapiens
LCLGTRASLLSPPHPTTPNHHPHTLPPRPLPRSNRYHPLPGSQSGRGPRPPCALFPTYLSWVRHREGRDQPNWAATPASTTFHHQLPNWSLCLPGALGSVWGS

SEQ ID NO: 825250 - protein, 178 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKVPLSPWGLGFCLGVMTFLVS

SEQ ID NO: 825251 - protein, 175 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTIKCNNALTPPERSPLPVEPVTSAFDTSLL

SEQ ID NO: 825252 - protein, 66 aa, Homo sapiens
ALSVGFWGFRGPALLEGWGEQVAMKCAIWLAEQRVPLSVQLKELSLVPLSPWGLGFCLGVMTFLVS

SEQ ID NO: 825253 - protein, 333 aa, Homo sapiens; identical to SEQ ID NO: 825241

SEQ ID NO: 825254 - protein, 333 aa, Homo sapiens; identical to SEQ ID NO: 825241

SEQ ID NO: 825255 - protein, 333 aa, Homo sapiens; identical to SEQ ID NO: 825241

SEQ ID NO: 825256 - protein, 333 aa, Homo sapiens; identical to SEQ ID NO: 825241

SEQ ID NO: 825257 - protein, 114 aa, Homo sapiens [sequence omitted]

SEQ ID NO: 825258 - protein, 126 aa, Homo sapiens
MTCWRVTWVSGTRSWRPPWWSWERTKGTRMSWPRPWTMVRGGGARPPAPLQSVPSPPWFPVWPGSPAPLCPVPHLPQLGQAQGGEGSAKLGGHPRLHHFPPSAAKLVPLSPWGLGFCLGVMTFLVS

SEQ ID NO: 825259 - protein, 505 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDDGEGRWGQAPCPAPIGTIPSLVPSLAGVPGPPVPCSPPTSAGSGTGRGGISQIGRPPPPPPLSTISCQTGPSVSLGPWVLFGGHDLPSFLTQGIQGRGLSFPPANAIMPSPLLRGAPSLWSLLPPHLTRVCCEPRNLLPTSHLSFQAHPWPRAGGREGRWRWVFVSEFAVLNIKNLSAVKKKPTQHTNKNTQGGPPKEIP

SEQ ID NO: 825260 - protein, 129 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMAERSPLPVEPVTSAFDTSLL

SEQ ID NO: 825261 - protein, 36 aa, Homo sapiens
MELFDSEDPRERDYLKTVLHRIYGKFLGLRAFIRKT

SEQ ID NO: 825262 - protein, 303 aa, Homo sapiens
MCHGRIAPKSTSVFAVASVGHGVFLPLVILCTLLGDGLASVCPLPPEPENGGYICHPRPCRDPLTAGSVIEYLCAEGYMLKGDYKYLTCKNGEWKPAMEISCRLNEDKDTHTSLGVPTLSIVASTASSVALILLLVVLFVLLQPKLKSFHHSRRDQGVSGDQVSIMVDGVQVALPSYEEAVYGSSGHCVPPADPRVQIVLSEGSGPSGRSVPREQQLPDQGACSSAGGEDEAPGQSGLCEAWGSRASETVMVHQATTSSWVAGSGNRQLAHKETADSENSDIQSLLSLTSEEYTDDIPLLKEA

SEQ ID NO: 825263 - protein, 303 aa, Homo sapiens; identical to SEQ ID NO: 825262

SEQ ID NO: 825264 - protein, 303 aa, Homo sapiens; identical to SEQ ID NO: 825262

SEQ ID NO: 825265 - protein, 468 aa, Homo sapiens
MNGEEEFFDAVTEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 825266 - protein, 480 aa, Homo sapiens
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 825267 - protein, 480 aa, Homo sapiens; identical to SEQ ID NO: 825266

SEQ ID NO: 825268 - protein, 480 aa, Homo sapiens; identical to SEQ ID NO: 825266

SEQ ID NO: 825269 - protein, 279 aa, Homo sapiens [sequence omitted]

SEQ ID NO: 825270 - protein, 88 aa, Homo sapiens
AGRGGGCLYSQLLGRLRLENHLNLDLASQEKERLEEKQREARRERAKEEAEWQTRWFYPGNNPYTGTPDWLYAGDYFERNFSDCPDIY

SEQ ID NO: 825271 - protein, 112 aa, Homo sapiens
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAIKPGKDTEEPKLHIAE

SEQ ID NO: 825272 - protein, 480 aa, Homo sapiens; identical to SEQ ID NO: 825266

SEQ ID NO: 825273 - protein, 480 aa, Homo sapiens; identical to SEQ ID NO: 825266

SEQ ID NO: 825274 - protein, 480 aa, Homo sapiens; identical to SEQ ID NO: 825266

SEQ ID NO: 825275 - protein, 412 aa, Homo sapiens
CGRSNIRMVHTLKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 825276 - protein, 243 aa, Homo sapiens
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLNVNQRHLRAKHKSPTNAGR

SEQ ID NO: 825277 - protein, 94 aa, Homo sapiens
RGRLWSREEAMATMENKVICALVLVSMLALGTLAEAQTETCTVAPRERQNCGFPGVTPSQCANKGCCFDDTVRGVPWCFYPNTIDVPPEEECEF

SEQ ID NO: 825278 - protein, 84 aa, Homo sapiens
YRSLLIFRPILSSQSQSSQSVLGAEAQTETCTVAPRERQNCGFPGVTPSQCANKGCCFDDTVRGVPWCFYPNTIDVPPEEECEF

SEQ ID NO: 825279 - protein, 94 aa, Homo sapiens; identical to SEQ ID NO: 825277

SEQ ID NO: 825280 - protein, 94 aa, Homo sapiens; identical to SEQ ID NO: 825277

SEQ ID NO: 825281 - protein, 82 aa, Homo sapiens
VADYRTLFADLGLVSCWPSAPGEAQTETCTVAPRERQNCGFPGVTPSQCANKGCCFDDTVRGVPWCFYPNTIDVPPEEECEF

SEQ ID NO: 825282 - protein, 133 aa, Homo sapiens
GRVGRPTRRGGSEEAKVQLPSVVPNPGSSDTSRLHHAAEVRPQRDQSRRCVLWLWPGLRDGASLGPAARAKLSPYGALKAAASQRPSRCCAAPAKPQPFWALASSRVGGEGGLDHLWRLGSPHALGIPEVHRR

SEQ ID NO: 825283 - protein, 155 aa, Homo sapiens
MTFMTRPPTIVAKLRKSVPPPADFLDAQECGDSPMDTREFMDEDLLVGTLLAIVFDGKSFSPKPRNVAEDPKNLTRRGGRRDSILRSPTPGFLRRETDSAGGRQPATTAQRSEEAKVQLPSVVPNPGSSDTSRLHHAAEVRPQRDQSRIPEVHRR

SEQ ID NO: 825284 - protein, 155 aa, Homo sapiens; identical to SEQ ID NO: 825283

SEQ ID NO: 825285 - protein, 155 aa, Homo sapiens; identical to SEQ ID NO: 825283

SEQ ID NO: 825286 - protein, 155 aa, Homo sapiens; identical to SEQ ID NO: 825283

SEQ ID NO: 825287 - protein, 155 aa, Homo sapiens; identical to SEQ ID NO: 825283

SEQ ID NO: 825288 - protein, 101 aa, Homo sapiens
DAWVDPRVGEARRRPRCNFLRSSRIRVHPTPAASTMPPKFDPNEIKVVGACSGCGRGCGMEHPSAPPRVQSFPRMGLLKPLPPRDLPGVAPPRPSLSLSGP

SEQ ID NO: 825289 - protein, 155 aa, Homo sapiens; identical to SEQ ID NO: 825283

SEQ ID NO: 825290 - protein, 155 aa, Homo sapiens; identical to SEQ ID NO: 825283

SEQ ID NO: 825291 - protein, 155 aa, Homo sapiens; identical to SEQ ID NO: 825283

SEQ ID NO: 825292 - protein, 101 aa, Homo sapiens; identical to SEQ ID NO: 825288

SEQ ID NO: 825293 - protein, 73 aa, Homo sapiens
DAWVDPRVGEARRRPRCNFLRSSRIRVHPTPAASTMPPKFDPNEIKVVYLRCTGGEGRCHFCPGPQDRPPGSD

SEQ ID NO: 825294 - protein, 133 aa, Homo sapiens; identical to SEQ ID NO: 825282

SEQ ID NO: 825295 - protein, 189 aa, Homo sapiens
GRVGRPTRRGGSEEAKVQLPSVVPNPGSSDTSRLHHAAEVRPQRDQSRTSALAPKIGPLGLSPKKVGDDIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 825296 - protein, 155 aa, Homo sapiens; identical to SEQ ID NO: 825283

SEQ ID NO: 825297 - protein, 215 aa, Homo sapiens
MLMAAILMTSSMTSTVVLWNAQPVKHKGKTIFTKGFILTNLGCTNKHTKQANNQNSTRKQETTRTHTQTTQANNKDAQENTKQQTQTATPHKKRHQAKKRTVNTQPNLQAEHKHNINQTHLTNYLNALNTETKPNSRPPKQRTRAIQHPQNTRNGPKDTPNTNTTHPTVNPEKNRTSKRDQTQNNQPMQHNMTNQNKNQERKKKHTQKLHHSTQT

SEQ ID NO: 825298 - protein, 155 aa, Homo sapiens; identical to SEQ ID NO: 825283

SEQ ID NO: 825299 - protein, 155 aa, Homo sapiens; identical to SEQ ID NO: 825283

SEQ ID NO: 825300 - protein, 155 aa, Homo sapiens; identical to SEQ ID NO: 825283

SEQ ID NO: 825301 - protein, 155 aa, Homo sapiens; identical to SEQ ID NO: 825283

SEQ ID NO: 825302 - protein, 155 aa, Homo sapiens; identical to SEQ ID NO: 825283

SEQ ID NO: 825303 - protein, 101 aa, Homo sapiens; identical to SEQ ID NO: 825288

SEQ ID NO: 825304 - protein, 101 aa, Homo sapiens; identical to SEQ ID NO: 825288

SEQ ID NO: 825305 - protein, 143 aa, Homo sapiens
RTRGSTHASGRLGGGQGATSFGRPESGFIRHQPPPPCRRSSTPTRSKSIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 825306 - protein, 101 aa, Homo sapiens; identical to SEQ ID NO: 825288

SEQ ID NO: 825307 - protein, 770 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825308 - protein, 780 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGVRGLPGLPPTQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825309 - protein, 780 aa, Homo sapiens; identical to SEQ ID NO: 825308

SEQ ID NO: 825310 - protein, 804 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAGLDFHLELVPGNGKFGLKEKSWILSRKSSFEIKSAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825311 - protein, 792 aa, Homo sapiens
MSHPFLPSLTYCFIHPPHSRPSVPLAGRPQTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825312 - protein, 786 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAGLDFHLELVPGNGKFGLKENLGFYRVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825313 - protein, 750 aa, Homo sapiens
MSYGLNIEMHKQTEIAKRLNTICAQVIPFLSQEHQQQVAQAVERAKQVTMAELNAIIGTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825314 - protein, 462 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSLHVTADGRGYHMEPP

SEQ ID NO: 825315 - protein, 229 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSQIRTLSSYSYSAAKLCASLKRAPTYTESKQ

SEQ ID NO: 825316 - protein, 108 aa, Homo sapiens
RESRERERVERERERERERERERERERERERERERERERERHLSHGHGPPVPLTPHPSGLQPPGIPPLGGSAGLLALSSALSGQSHLAIARLGLCPHTLTVLQSCVHR

SEQ ID NO: 825317 - protein, 770 aa, Homo sapiens; identical to SEQ ID NO: 825307

SEQ ID NO: 825318 - protein, 696 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825319 - protein, 914 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAGLDFHLELVPGNGKFGLKEKSWILSRKSSFEIKSGKHLVPVPWFALCKLGREYLNSPGFLVLPFTQMRKCVGCASPGVFSFLEMHSLWGRRDPVYKLEVIFPLPRSLTSFSLPMSDTEQMMRPDLLVRFDGVGQLNDVGLCFLSAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825320 - protein, 755 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825321 - protein, 708 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEEPFFSSNDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 825322 - protein, 239 aa, Homo sapiens
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGVRGLPGLPPTQQQLQAQHLSHGHGPPVPLTPHPSGLQPPGIPPLGGSAGLLALSSALSGQSHLAIKDDKKHHDAEHHRDREPGTSQIRTLSSYSYSAAKLCASLKRAPTYTESKQ

SEQ ID NO: 825323 - protein, 609 aa, Homo sapiens
MFRCGGLAAGALKQKLVPLVRTVCVRSPRQRNRLPVVQSHHLGSPSRSLASTGASGKDGSNLVYFLIVGATVTGAGVYYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825324 - protein, 326 aa, Homo sapiens
MFRCGGLAAGALKQKLVPLVRTVCVRSPRQRNRLPARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825325 - protein, 145 aa, Homo sapiens [sequence omitted]

SEQ ID NO: 825326 - protein, 226 aa, Homo sapiens
MVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825327 - protein, 369 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRRVESAVASYLSS

SEQ ID NO: 825328 - protein, 176 aa, Homo sapiens
DSQWSLLLLDLLRIPSNSYLERRRSALRILALTFNFRVLYIEEESRSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825329 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825330 - protein, 274 aa, Homo sapiens
MGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825331 - protein, 251 aa, Homo sapiens
GCCHAEVSGDNRQWCSLVEESFRKYHQETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 825332 - protein, 482 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMF

SEQ ID NO: 825333 - protein, 518 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGQLNIGLQAHSCHCVVSFYLPAVFQLDK

SEQ ID NO: 825334 - protein, 279 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYGAGAEVKSRTTLFRIGDFRSLEDFRG

SEQ ID NO: 825335 - protein, 552 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 825336 - protein, 153 aa, Homo sapiens
TPLLGHSPSRQVDLLYLAGSRGSKLTPRGSGARERCEENRPGTAHAGAGRPACPDGATVRCRCLSLQAFPLPAPLQLLCRGPTAARSGRDLWPKTWPSWSVLCPSQEAVRHLLPASWWADPVLSLQSTCSQVGQPGSGVLTEGLSPEPPHPEG

SEQ ID NO: 825337 - protein, 543 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 825338 - protein, 651 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRYRVSPRTAQVLHPFPASRAHPVGWRGDSAGGGAGAVCCCPGFLPVSGTCPLPQTSAPCPGPWSRCGHGRLRGGRVPGCFLHLSLLTETPRERFLHIVPGKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 825339 - protein, 441 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRYRVSPRTAQVLHPFPASRAHPVGWRGDSAGGGAGGRGAAARASCLSLVLAPCPRRRLRVLGPGPDVAMGD

SEQ ID NO: 825340 - protein, 419 aa, Homo sapiens
TSTGVPPSPPVGICSECAVSRGLTRVMPQQEPACHRPCSCRAAVEGDSGPRSVTVCLILGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 825341 - protein, 515 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVPCCS

SEQ ID NO: 825342 - protein, 410 aa, Homo sapiens [sequence omitted]

SEQ ID NO: 825343 - protein, 132 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGHRA

SEQ ID NO: 825344 - protein, 552 aa, Homo sapiens; identical to SEQ ID NO: 825335

SEQ ID NO: 825345 - protein, 410 aa, Homo sapiens [sequence omitted]

SEQ ID NO: 825346 - protein, 500 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 825347 - protein, 290 aa, Homo sapiens
NLRPSPNSRASQNPGAAQPRDVALLQERANKLVKYLMLKDYTKVPIKRSEMLRDIIREYTDVYPEIIELMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 825348 - protein, 305 aa, Homo sapiens
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGAVRCHLPWGSREEERLGPRLLLGCQWWQCPGRAQNMNQHSARQGRSGPVSAPKPEGAGLRAPAEPASWKDEGKNAWCTGPCVCVGSLHLIAVWKISVPRFGECSYFPYKLSF

SEQ ID NO: 825349 - protein, 116 aa, Homo sapiens
SRGGASGGGRELGGRRQHCFKLAKLTRARGILRSIPTRGHGTGPCFPLLGPREPGSAFCRVPRPPLQGRADPTRWRFMENFQKVEKIGEGTYGVVYKARNKLTGEVVALKKIRLDT

SEQ ID NO: 825350 - protein, 341 aa, Homo sapiens
SRGGASGGGRELGGRRQHCFKLAKLTRARGILRSIPTRGHGTGPCFPLLGPREPGSAFCRVPRPPLQGRADPTRWRFMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 825351 - protein, 368 aa, Homo sapiens
SRGGASGGGRELGGRRQHCFKLAKLTRARGILRSIPTRGHGTGPCFPLLGPREPGSAFCRVPRPPLQGRADPTRWRFMENFQKVEKIGEGTYGVVYKARNKLKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 825352 - protein, 375 aa, Homo sapiens
SRGGASGGGRELGGRRQHCFKLAKLTRARGILRSIPTRGHGTGPCFPLLGPREPGSAFCRVPRPPLQGRADPTRWRFMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 825353 - protein, 375 aa, Homo sapiens; identical to SEQ ID NO: 825352

SEQ ID NO: 825354 - protein, 142 aa, Homo sapiens
SRGGASGGGRELGGRRQHCFKLAKLTRARGILRSIPTRGHGTGPCFPLLGPREPGSAFCRVPRPPLQGRADPTRWRFMENFQKVEKIGEGTYGVVYKARNKLTGEVVALKKIRLDTETEGVPSTAIREISLLKELNHPNIVK

SEQ ID NO: 825355 - protein, 195 aa, Homo sapiens
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLSVQEFIKRDQ

SEQ ID NO: 825356 - protein, 195 aa, Homo sapiens; identical to SEQ ID NO: 825355

SEQ ID NO: 825357 - protein, 195 aa, Homo sapiens; identical to SEQ ID NO: 825355

SEQ ID NO: 825358 - protein, 195 aa, Homo sapiens; identical to SEQ ID NO: 825355

SEQ ID NO: 825359 - protein, 195 aa, Homo sapiens; identical to SEQ ID NO: 825355

SEQ ID NO: 825360 - protein, 195 aa, Homo sapiens; identical to SEQ ID NO: 825355

SEQ ID NO: 825361 - protein, 200 aa, Homo sapiens
FSSFSPCLFFLLIKQRSFGGFIPIADKRGKDGKCSRFLSFHKQEFHALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLSVQEFIKRDQ

SEQ ID NO: 825362 - protein, 217 aa, Homo sapiens
ACSRVRTRSQQWGCTRASSRGGNKMEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKNAIRIGHVGMQIGAHH

SEQ ID NO: 825363 - protein, 71 aa, Homo sapiens
ACSRVRTRSQQWGCTRASSRGGNKMEDSASASLSSAAATGTSTSTPAAPTARKQLDKEQDFQKNCQRSGRA

SEQ ID NO: 825364 - protein, 118 aa, Homo sapiens
ACSRVRTRSQQWGCTRASSRGGNKMEDSASASLSSAAATGTSTSTPAAPTARKQLDKEQVRKAVDALLTHCKSRKNNYGLLLNENESLFLMVVLWKIPSKELRVRLDEILRCCPAGVQ

SEQ ID NO: 825365 - protein, 195 aa, Homo sapiens; identical to SEQ ID NO: 825355

SEQ ID NO: 825366 - protein, 195 aa, Homo sapiens; identical to SEQ ID NO: 825355

SEQ ID NO: 825367 - protein, 195 aa, Homo sapiens; identical to SEQ ID NO: 825355

SEQ ID NO: 825368 - protein, 195 aa, Homo sapiens; identical to SEQ ID NO: 825355

SEQ ID NO: 825369 - protein, 195 aa, Homo sapiens; identical to SEQ ID NO: 825355

SEQ ID NO: 825370 - protein, 172 aa, Homo sapiens
LARACAPEASSGVAHAPLHEVETRWRIRPRPRCLLQPLLEPPPRLQRPRQHGSSWIKNRTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLSVQEFIKRDQ

SEQ ID NO: 825371 - protein, 338 aa, Homo sapiens
ACSRVRTRSQQWGCTRASSRGGNKMEDSASASLSSAAATGTSTSTPAAPTARKQLDKEQCYTYWSRWNANWSTSLKTIVAVTKGLSEKLPEKWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKKPKIKEEAVKEKSPSLGKKDARQTPKKPEAKFFTTPSKSVRKASHTPKKWPKKPKVPQST

SEQ ID NO: 825372 - protein, 951 aa, Homo sapiens
AGGRGNARSSQALGVSWCPATWHPRLDMGRLHRPRSSTSYRNLPHLFLFFLFVGPFSCLGSYSRATELLYSLNEGLPAGVLIGSLAEDLRLLPRSAGRPDPQSQLPERTGAEWNPPLSFSLASRGLSGQYVTLDNRSGELHTSAQEIDREALCVEGGGGTAWSGSVSISSSPSDSCLLLLDVLVLPQEYFRFVKVKIAIRDINDNAPQFPVSQISVWVPENAPVNTRLAIEHPAVDPDVGINGVQTYRLLDYHGMFTLDVEENENGERTPYLIVMGALDRETQDQYVSIIIAEDGGSPPLLGSATLTIGISDINDNCPLFTDSQINVTVYGNATVGTPIAAVQAVDKDLGTNAQITYSYSQKVPQASKDLFHLDENTGVIKLFSKIGGSVLESHKLTILANGPGCIPAVITALVSIIKVIFRPPEIVPRYIANEIDGVVYLKELEPVNTPIAFFTIRDPEGKYKVNCYLDGEGPFRLSPYKPYNNEYLLETTKPMDYELQQFYEVAVVAWNSEGFHVKRVIKVQLLDDNDNAPIFLQPLIELTIEENNSPNAFLTKLYATDADSEERGQVSYFLGPDAPSYFSLDSVTGILTVSTQLDREEKEKYRYTVRAVDCGKPPRESVATVALTVLDKNDNSPRFINKDFSFFVPENFPGYGEIGVISVTDADAGRNGWVALSVVNQSDIFVIDTGKGMLRAKVSLDREQQSSYTLWVEAVDGGEPALSSTAKITILLLDINDNPPLVLFPQSNMSYLLVLPSTLPGSPVTEVYAVDKDTGMNAVIAYSIIGRRGPRPESFRIDPKTGNITLEEALLQTDYGLHRLLVKVSDHGYPEPLHSTVMVNLFVNDTVSNESYIESLLRKEPEINIEEKEPQISIEPTHRKVESVSCMPTLVALSVISLGSITLVTGMGIYICLRKGEKHPREDENLEVQIPLKGKIDLHMRERKPMDISNI

SEQ ID NO: 825373 - protein, 713 aa, Homo sapiens
AGGRGNARSSQALGVSWCPATWHPRLDMGRLHRPRSSTSYRNLPHLFLFFLFVGPFSCLGSYSRATELLYSLNEGLPAGVLIGSLAEDLRLLPRSAGRPDPQSQLPERTGAEWNPPLSFSLASRGLSGQYVTLDNRSGELHTSAQEIDREALCVEGGGGTAWSGSVSISSSPSDSCLLLLDVLVLPQEYFRFVKVKIAIRDINDNAPQFPVSQISVWVPENAPVNTRLAIEHPAVDPDVGINGVQTYRLLDYHGMFTLDVEENENGERTPYLIVMGALDRETQDQYVSIIIAEDGGSPPLLGSATLTIGISDINDNCPLFTDSQINVTVYGNATVGTPIAAVQAVDKDLGTNAQITYSYSQKVPQASKDLFHLDENTGVIKLFSKIGGSVLESHKLTILANGPGCIPAVITALVSIIKVIFRPPEIVPRYIANEIDGVVYLKELEPVNTPIAFFTIRDPEGKYKVNCYLDGEGPFRLSPYKPYNNEYLLETTKPMDYELQQFYEVAVVAWNSEGFHVKRVIKVQLLDDNDNAPIFLQPLIELTIEENNSPNAFLTKLYATDADSEERGQVSYFLGPDAPSYFSLDSVTGILTVSTQLDREEKEKYRYTVRAVDCGKPPRESVATVALTVLDKNDNSPRFINKDFSFFVPENFPGYGEIGVISVTDADAGRNGWVALSVVNQSDIFVIDPGKRYLWGKTSLGLSLQMYLILLCV

SEQ ID NO: 825374 - protein, 631 aa, Homo sapiens
MLPVDGEERKSEGSDTEGDRTSPCAVSSATLKDLEVGGSGRRCSDPAGQPSNLLPQRGLGAPLPAETAHTQPSPNDRSLYLSPKSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQNVHRLLTEPGDSAKDASPGGGHHQAGPGQGGEEGEAAGAAGDGVAACGSYNEGHGKFLAAAQNPAAEPSPGAPAPQELGAADKHGDLCEASLTNSVEPAQGEAREGSSQDNPTAQPIVQLLGEMQDHQEHPGLGSNCCVPCFCWAWLPRRRR

SEQ ID NO: 825375 - protein, 460 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQNVHRLLTEPGDSAKDASPGGGHHQAGPGQGGEEGEAAGAAGDGVAACGSYNEGHGKFLAAAQNPAAEPSPGAPAPQELGAADKHGDLCEASLTNSVEPAQGEAREGSSQDNPTAQPIVQLLGEMQDHQEHPGLGSNCCVPCFCWAWLPRRRR

SEQ ID NO: 825376 - protein, 603 aa, Homo sapiens
MAEETGQSKLAAAKKKFKEYWQRNRPGVPAAAKRNTKANGSSPETAASGGCHSSEASSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQNVHRLLTEPGDSAKDASPGGGHHQAGPGQGGEEGEAAGAAGDGVAACGSYNEGHGKFLAAAQNPAAEPSPGAPAPQELGAADKHGDLCEASLTNSVEPAQGEAREGSSQDNPTAQPIVQLLGEMQDHQEHPGLGSNCCVPCFCWAWLPRRRR

SEQ ID NO: 825377 - protein, 603 aa, Homo sapiens; identical to SEQ ID NO: 825376

SEQ ID NO: 825378 - protein, 109 aa, Homo sapiens
QFCVPIEGTDLVTGGSDAWFPVVEFVFRKPSPQSSGLADKHGDLCEASLTNSVEPAQGEAREGSSQDNPTAQPIVQLLGEMQDHQEHPGLGSNCCVPCFCWAWLPRRRR

SEQ ID NO: 825379 - protein, 460 aa, Homo sapiens; identical to SEQ ID NO: 825375

SEQ ID NO: 825380 - protein, 460 aa, Homo sapiens; identical to SEQ ID NO: 825375

SEQ ID NO: 825381 - protein, 460 aa, Homo sapiens; identical to SEQ ID NO: 825375

SEQ ID NO: 825382 - protein, 70 aa, Homo sapiens
AEARHCLARLLEGDLAADGEGEHRGPQVPKQGSMGRAAGIGSTEMRKKKNTCSAPETRKGTEIGGQKEVH

SEQ ID NO: 825383 - protein, 617 aa, Homo sapiens
MVQGIIRDSLEVAYLSKEDLEVGGSGRRCSDPAGQPSNLLPQRGLGAPLPAETAHTQPSPNDRSLYLSPKSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQNVHRLLTEPGDSAKDASPGGGHHQAGPGQGGEEGEAAGAAGDGVAACGSYNEGHGKFLAAAQNPAAEPSPGAPAPQELGAADKHGDLCEASLTNSVEPAQGEAREGSSQDNPTAQPIVQLLGEMQDHQEHPGLGSNCCVPCFCWAWLPRRRR

SEQ ID NO: 825384 - protein, 460 aa, Homo sapiens; identical to SEQ ID NO: 825375

SEQ ID NO: 825385 - protein, 460 aa, Homo sapiens; identical to SEQ ID NO: 825375

SEQ ID NO: 825386 - protein, 979 aa, Homo sapiens
MSILRQLTYRRCDSHPRLIKELLACIAEECLKQHRTDVSFVDRSFTRDSTQKGWYQADVSGESKIVATQLTEELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 825387 - protein, 444 aa, Homo sapiens
LGRGGVNGRVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 825388 - protein, 377 aa, Homo sapiens
GQRTRGLPPSWKRPATILGALGARTPWGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 825389 - protein, 974 aa, Homo sapiens [sequence omitted]

SEQ ID NO: 825390 - protein, 974 aa, Homo sapiens [sequence omitted]

SEQ ID NO: 825391 - protein, 831 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVVSEVGMTRCQLTRLGMRADAAQRQSDIQA

SEQ ID NO: 825392 - protein, 771 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSERGDPKRKQA

SEQ ID NO: 825393 - protein, 473 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQG

SEQ ID NO: 825394 - protein, 402 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQVRAFYKGC

SEQ ID NO: 825395 - protein, 52 aa, Homo sapiens
MNLHLVLIDELHRHLYIKSTSRVVQRNKEKGKIRLKRLFAISVLWQCRIGRN

SEQ ID NO: 825396 - protein, 974 aa, Homo sapiens [sequence omitted]

SEQ ID NO: 825397 - protein, 576 aa, Homo sapiens
KTKMSKGEDPNNPRSIKRISQGGRDNHLAIAKCDLTQLKKKQSEVSNGSRETISMKTCCQHGDRGYWSTGYYWRGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 825398 - protein, 974 aa, Homo sapiens [sequence omitted]

SEQ ID NO: 825399 - protein, 912 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSPGHQSSCCPWFIGHRRQQCTDWATS

SEQ ID NO: 825400 - protein, 896 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFAR

SEQ ID NO: 825401 - protein, 474 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGE

SEQ ID NO: 825402 - protein, 593 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQVIIHFELTIFISNFH

SEQ ID NO: 825403 - protein, 225 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKIRLKRLFA

SEQ ID NO: 825404 - protein, 209 aa, Homo sapiens
MAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 825405 - protein, 104 aa, Homo sapiens
MVMAALPFSEDLKMPDTCVLPHCPGKENKDGLDKLLDAGLYTGEVTEIVGGPGSGKTQAEALRRIQVVHAFDIFQMLDVLQELRGTVAQQVSLLFCPSLLNSAF

SEQ ID NO: 825406 - protein, 328 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 825407 - protein, 388 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGRHGGRTQVGTWEDCSCLRSPQGDRGVGSGMLLKKAGLGHGGTDGLSLNAFDERGTAVSTSRLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 825408 - protein, 328 aa, Homo sapiens; identical to SEQ ID NO: 825406

SEQ ID NO: 825409 - protein, 373 aa, Homo sapiens
MIQLLRSHRIKTVVDLVSADLEEVAQKCGLSYKALVALRRVLLAQFSAFPVNGADLYEELKTSTAILSTGIGRHGGRTQVGTWEDCSCLRSPQGDRGVGSGMLLKKAGLGHGGTDGLSLNAFDERGTAVSTSRLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 825410 - protein, 565 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGSLDKLLDAGLYTGEVTEIVGGPGSGKTQAEALRRIQVVHAFDIFQMLDVLQELRGTVAQQVSLLFCPSLLNSAFWCYLCGQVSYYRLFGNADVQSGDSNYAVLLPGWNSRAPKSHTSLFTCSSSLLNSKATLSGRIMSYLCLHSPLGDWFFRNCEGGGCGLGHCGGFPTSGRSAEGRLGLDDAAGPRAEDPGPGPWHGSGGDQPHNSRQGQREAQTCPRTLLELCAQHSDSPGHHRGSRSIRRPAHGVSGQIFPTDFIMWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQGQWPCVSGSRGTRLPGERGQSTC

SEQ ID NO: 825411 - protein, 118 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGRHGGRTQVGTWEDCSCLRSPQGDRGVGSGML

SEQ ID NO: 825412 - protein, 220 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQGQWPCVSGSRGTRLPGERGQSTC

SEQ ID NO: 825413 - protein, 209 aa, Homo sapiens; identical to SEQ ID NO: 825404

SEQ ID NO: 825414 - protein, 220 aa, Homo sapiens; identical to SEQ ID NO: 825412

SEQ ID NO: 825415 - protein, 220 aa, Homo sapiens; identical to SEQ ID NO: 825412

SEQ ID NO: 825416 - protein, 226 aa, Homo sapiens
MNKDFIMWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQGQWPCVSGSRGTRLPGERGQSTC

SEQ ID NO: 825417 - protein, 342 aa, Homo sapiens
MSYLCLHSPLGDWFFRNCEGGGCGLGHCGGFPTSGRSAEGRLGLDDAAGPRAEDPGPGPWHGSGGDQPHNSRQGQREAQTCPRTLLELCAQHSDSPGHHRGSRSIRRPAHGVSGQIFPTDFIMWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQGQWPCVSGSRGTRLPGERGQSTC

SEQ ID NO: 825418 - protein, 342 aa, Homo sapiens; identical to SEQ ID NO: 825417

SEQ ID NO: 825419 - protein, 209 aa, Homo sapiens; identical to SEQ ID NO: 825404

SEQ ID NO: 825420 - protein, 70 aa, Homo sapiens
PPPPPFWGWGGEKNNNPPQFTPAEGAGASGGRRMACLAKSSRQPTGFQEMVDIGTWGTSEQSATLQGDQT

SEQ ID NO: 825421 - protein, 303 aa, Homo sapiens
MQLARELKTLARDLGMAVVVTNHITRDRDSGRLKPALGRSWSFVPSTRILLDTIEGAGASGGRRMACLAKSSRQILSCGQPAATGSAWMDSLRRSHHPREPGCRPIPTLGTAPSLPQQAWNQAASPVGLTLQTRPGRANGHVSQDQEEPVYLESVARVPAEDETQSIDSEDSFVPGRRASLSDLTDLEDIEGLTVRQLKEILARNFVNYKGCCEKWELMERVTRLYKDQKGLQHLVSGAEDQNGGAVPSGLEENLCKICMDSPIDCVLLECGHMVTCTKCGKRMNECPICRQYVIRAVHVFRS

SEQ ID NO: 825422 - protein, 110 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGRFVCVLGEEGERQEDGASSQLCF

SEQ ID NO: 825423 - protein, 282 aa, Homo sapiens
WNPEAAARRDPAGGLWARESRRIPGGRMTPSPTLGAASSSLLSPPAASAPVSSLGRVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVRKQAWP

SEQ ID NO: 825424 - protein, 328 aa, Homo sapiens; identical to SEQ ID NO: 825406

SEQ ID NO: 825425 - protein, 328 aa, Homo sapiens; identical to SEQ ID NO: 825406

SEQ ID NO: 825426 - protein, 342 aa, Homo sapiens; identical to SEQ ID NO: 825417

SEQ ID NO: 825427 - protein, 342 aa, Homo sapiens; identical to SEQ ID NO: 825417

SEQ ID NO: 825428 - protein, 405 aa, Homo sapiens
MAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQIFIMWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQGQWPCVSGSRGTRLPGERGQSTC

SEQ ID NO: 825429 - protein, 342 aa, Homo sapiens; identical to SEQ ID NO: 825417

SEQ ID NO: 825430 - protein, 209 aa, Homo sapiens; identical to SEQ ID NO: 825404

SEQ ID NO: 825431 - protein, 412 aa, Homo sapiens
MGVLRVGLCPGLTEEMIQLLRSHRIKTVVDLVSADLEEVAQKCGLSYKAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQIFIMWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQGQWPCVSGSRGTRLPGERGQSTC

SEQ ID NO: 825432 - protein, 220 aa, Homo sapiens; identical to SEQ ID NO: 825412

SEQ ID NO: 825433 - protein, 216 aa, Homo sapiens
MGVLRVGLCPGLTEEMIQLLRSHRIKTVVDLVSADLEEVAQKCGLSYKAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 825434 - protein, 151 aa, Homo sapiens
MLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 825435 - protein, 234 aa, Homo sapiens
MSYLCLHSPLGDWFFRNCEGGGCGLGHCGGFPTSGRSAEGRLGLDDAAGPRAEDPGPGPWHGSGGDQPHNSRQGQREAQTCPRTLLELCAQHSDSPGHHRGSRSIRRPAHGVSGQIFPTDFIMWATCCNWFCLDGQPEEVPPPQGARMQAYSNPGYSSFRSTYLTQPPLFICTSHLCSPSPGSGESAGPMAMCLRIKRNPSTWRAWPEYLLRMRPSLLTQRTALSQAEGPLCLT

SEQ ID NO: 825436 - protein, 388 aa, Homo sapiens; identical to SEQ ID NO: 825407

SEQ ID NO: 825437 - protein, 112 aa, Homo sapiens
MWATCCNWFCLDGQPEEVPPPQGARMQAYSNPGYSSFPSPTGLEPSCKSCGAHFANTARKVSADFLACSATAAYGPWASATDPSECLQPFLSLCDAGDPELSLSQKCSRRTN

SEQ ID NO: 825438 - protein, 117 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFNRIFTSYRSWIIQVQNEF

SEQ ID NO: 825439 - protein, 117 aa, Homo sapiens; identical to SEQ ID NO: 825438

SEQ ID NO: 825440 - protein, 110 aa, Homo sapiens
VGLSVGRLSVSAYLEETEELKRFDDPGLMLMGFKPLVLLKKHHYLRPSLFVYPEESLVIGSSTLFSALLIKCLEKEVAALCRYTPLEYNLPVEYNLPVEYNLPVEYNLPV

SEQ ID NO: 825441 - protein, 157 aa, Homo sapiens [sequence omitted]

SEQ ID NO: 825442 - protein, 262 aa, Homo sapiens [sequence omitted]

SEQ ID NO: 825443 - protein, 262 aa, Homo sapiens [sequence omitted]

SEQ ID NO: 825444 - protein, 262 aa, Homo sapiens [sequence omitted]

SEQ ID NO: 825445 - protein, 262 aa, Homo sapiens [sequence omitted]

SEQ ID NO: 825446 - protein, 262 aa, Homo sapiens [sequence omitted]

SEQ ID NO: 825447 - protein, 262 aa, Homo sapiens [sequence omitted]

SEQ ID NO: 825448 - protein, 262 aa, Homo sapiens [sequence omitted]

SEQ ID NO: 825449 - protein, 262 aa, Homo sapiens [sequence omitted]

SEQ ID NO: 825450 - protein, 262 aa, Homo sapiens [sequence omitted]

SEQ ID NO: 825451 - protein, 262 aa, Homo sapiens [sequence omitted]

SEQ ID NO: 825452 - protein, 262 aa, Homo sapiens [sequence omitted]

SEQ ID NO: 825453 - protein, 157 aa, Homo sapiens [sequence omitted]

SEQ ID NO: 825454 - protein, 262 aa, Homo sapiens [sequence omitted]

SEQ ID NO: 825455 - protein, 164 aa, Homo sapiens
MPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 825456 - protein, 262 aa, Homo sapiens [sequence omitted]

SEQ ID NO: 825457 - protein, 262 aa, Homo sapiens [sequence omitted]

SEQ ID NO: 825458 - protein, 117 aa, Homo sapiens; identical to SEQ ID NO: 825438

SEQ ID NO: 825459 - protein, 264 aa, Homo sapiens [sequence omitted]

SEQ ID NO: 825460 - protein, 117 aa, Homo sapiens; identical to SEQ ID NO: 825438

SEQ ID NO: 825461 - protein, 117 aa, Homo sapiens; identical to SEQ ID NO: 825438

SEQ ID NO: 825462 - protein, 117 aa, Homo sapiens; identical to SEQ ID NO: 825438

SEQ ID NO: 825463 - protein, 117 aa, Homo sapiens; identical to SEQ ID NO: 825438

SEQ ID NO: 825464 - protein, 117 aa, Homo sapiens; identical to SEQ ID NO: 825438

SEQ ID NO: 825465 - protein, 142 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFNRIFTSYRSWIIQLPFRSVARLPGLVLSQLKCVSPELGRVYPT

SEQ ID NO: 825466 - protein, 58 aa, Homo sapiens
MSGWESYYKTEGDEEAEEEQEENLEASETMNIQEIKSITEINANFEKSVRLNKDRQNK

SEQ ID NO: 825467 - protein, 117 aa, Homo sapiens; identical to SEQ ID NO: 825438

SEQ ID NO: 825468 - protein, 46 aa, Homo sapiens
MSGWESYYKTEGDEEAEEEQEENLEASADYQISITTDLLTTHNDLL

SEQ ID NO: 825469 - protein, 155 aa, Homo sapiens
MRGSTHASGLSVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 825470 - protein, 262 aa, Homo sapiens [sequence omitted]

SEQ ID NO: 825471 - protein, 262 aa, Homo sapiens [sequence omitted]

SEQ ID NO: 825472 - protein, 262 aa, Homo sapiens [sequence omitted]

SEQ ID NO: 825473 - protein, 262 aa, Homo sapiens [sequence omitted]

SEQ ID NO: 825474 - protein, 262 aa, Homo sapiens [sequence omitted]

SEQ ID NO: 825475 - protein, 262 aa, Homo sapiens [sequence omitted]

SEQ ID NO: 825476 - protein, 262 aa, Homo sapiens [sequence omitted]

SEQ ID NO: 825477 - protein, 220 aa, Homo sapiens
MGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 825478 - protein, 233 aa, Homo sapiens
MGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHAAGSPHQALPGLTRGRASSCPSAVWPGCLALSSAS

SEQ ID NO: 825479 - protein, 168 aa, Homo sapiens
MGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTWPQGEAMK

SEQ ID NO: 825480 - protein, 117 aa, Homo sapiens; identical to SEQ ID NO: 825438

SEQ ID NO: 825481 - protein, 157 aa, Homo sapiens [sequence omitted]

SEQ ID NO: 825482 - protein, 117 aa, Homo sapiens; identical to SEQ ID NO: 825438

SEQ ID NO: 825483 - protein, 117 aa, Homo sapiens; identical to SEQ ID NO: 825438

SEQ ID NO: 825484 - protein, 104 aa, Homo sapiens
MSGWESYYKTEGDEEAEEEQEENLEASGDYKYSGRDSLIFLVDASKAMFESQTGSFKHLTVKEAVLNGLVATEVFDVVYVGEIIGKRGIIGYDVEAQSLTSDYI

SEQ ID NO: 825485 - protein, 202 aa, Homo sapiens
AAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGSGMYMHACFVVLWVKRSHTNVHNVAILSIFKKLPCFDTANSVFVHWNDKKMFHFLFSQKA

SEQ ID NO: 825486 - protein, 117 aa, Homo sapiens
AAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGSS

SEQ ID NO: 825487 - protein, 382 aa, Homo sapiens
MSLEWSEASASFLECFLRGAAMQEYMLIFPVRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 825488 - protein, 213 aa, Homo sapiens
GLDDNVNDGKCNTRRVLQGGPVETSGTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 825489 - protein, 412 aa, Homo sapiens
AAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 825490 - protein, 145 aa, Homo sapiens
AAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGSPD

SEQ ID NO: 825491 - protein, 412 aa, Homo sapiens; identical to SEQ ID NO: 825489

SEQ ID NO: 825492 - protein, 412 aa, Homo sapiens; identical to SEQ ID NO: 825489

SEQ ID NO: 825493 - protein, 246 aa, Homo sapiens
AAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGGDLGDFMDYGEAAVAQVTE

SEQ ID NO: 825494 - protein, 923 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825495 - protein, 945 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVCMDLARCRNWHPHSCSYPCPLGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825496 - protein, 871 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825497 - protein, 656 aa, Homo sapiens
MVYTASHAGVLGASASVTFSVVITTLADQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825498 - protein, 568 aa, Homo sapiens
GWARPKVASVPGPDLVVSISLQSFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825499 - protein, 375 aa, Homo sapiens
MKPVGDYENDCAGEAYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825500 - protein, 923 aa, Homo sapiens; identical to SEQ ID NO: 825494

SEQ ID NO: 825501 - protein, 923 aa, Homo sapiens; identical to SEQ ID NO: 825494

SEQ ID NO: 825502 - protein, 844 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSHLPLFGYPFYGVLRVSMQALSGPTLLGLNRQHL

SEQ ID NO: 825503 - protein, 274 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTVSIS

SEQ ID NO: 825504 - protein, 429 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSKKEAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 825505 - protein, 862 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825506 - protein, 923 aa, Homo sapiens; identical to SEQ ID NO: 825494

SEQ ID NO: 825507 - protein, 573 aa, Homo sapiens
MNSPIFVKLESHCFTQAAVLWYQSELTVASNSWTQVILLPQPCEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825508 - protein, 134 aa, Homo sapiens
MTISFLLFIVLQPFFSKDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 825509 - protein, 835 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQSRLTVSQRHQGAGRIAREIDSRRSCILAS

SEQ ID NO: 825510 - protein, 383 aa, Homo sapiens
VASELQSTCELAEVSSDSSPLQPGPTRPHPAPALARRPRPAMGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYT

SEQ ID NO: 825511 - protein, 218 aa, Homo sapiens
RAEVAVASRIAKRRGAEAVPLASVYAASFSRRRPLGSHSARDSGPDAARTWTPPAKVPAGPGPFAADGPRLPVVLRLPGSRLRLSVLSVSVHPPRGPSSAPGATDLEAYDGRGVFFARGPDRFLGSLQPPSWSPWDRSEVWFPGARRCSRSLGSVAPSRSRLCRPPRALAGPSGSRCLALDPVRGVEGGSRAEKGSSRSAELPLGSNSARSSACLGVA

SEQ ID NO: 825512 - protein, 220 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 825513 - protein, 200 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 825514 - protein, 209 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 825515 - protein, 229 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 825516 - protein, 206 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRNSATFKSFEDRVGTIKSKVVGDRENGSDNLPSSAGSGDKPLSDPAPF

SEQ ID NO: 825517 - protein, 206 aa, Homo sapiens; identical to SEQ ID NO: 825516

SEQ ID NO: 825518 - protein, 110 aa, Homo sapiens
MTERGRHLPSCTVKGFPVALCDVWTCTLWLLGMADLTFDLGSLRNDLAVSQFCHEILGCCYGTLWRLALTLRPFRVRRAAQPSPLDTDTLPSLFKGTLRPSSRLRTELGP

SEQ ID NO: 825519 - protein, 206 aa, Homo sapiens; identical to SEQ ID NO: 825516

SEQ ID NO: 825520 - protein, 206 aa, Homo sapiens; identical to SEQ ID NO: 825516

SEQ ID NO: 825521 - protein, 187 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRNSATFKSFEDRVGTIKVIVPGLFDGLGK

SEQ ID NO: 825522 - protein, 206 aa, Homo sapiens; identical to SEQ ID NO: 825516

SEQ ID NO: 825523 - protein, 186 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRNSATFKSFEDRVGTIKSKVVGDRENGSDNLPSSAGSGDKPLSDPAPF

SEQ ID NO: 825524 - protein, 206 aa, Homo sapiens; identical to SEQ ID NO: 825516

SEQ ID NO: 825525 - protein, 206 aa, Homo sapiens; identical to SEQ ID NO: 825516

SEQ ID NO: 825526 - protein, 206 aa, Homo sapiens; identical to SEQ ID NO: 825516

SEQ ID NO: 825527 - protein, 164 aa, Homo sapiens
TTTKFAAASTKSPSLVSSQLPMAVLSPLPVLCAGQLGVPPVRPREDPGVEFPLGALCGGAGSSLQLLGVGESQLCPSLPSWGCVWILVLTLASFSASAMLPSSSYSIRHSISMPAMRNSATFKSFEDRVGTIKSKVVGDRENGSDNLPSSAGSGDKPLSDPAPF

SEQ ID NO: 825528 - protein, 206 aa, Homo sapiens; identical to SEQ ID NO: 825516

SEQ ID NO: 825529 - protein, 206 aa, Homo sapiens; identical to SEQ ID NO: 825516

SEQ ID NO: 825530 - protein, 224 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRTLRHIKSIDNRAGTMIFRCGCSHESTYVTTSRATARIGYKHSLRSDIYKNTQVVIHSRPHTTQTQ

SEQ ID NO: 825531 - protein, 584 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATAQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 825532 - protein, 584 aa, Homo sapiens; identical to SEQ ID NO: 825531

SEQ ID NO: 825533 - protein, 584 aa, Homo sapiens; identical to SEQ ID NO: 825531

SEQ ID NO: 825534 - protein, 584 aa, Homo sapiens; identical to SEQ ID NO: 825531

SEQ ID NO: 825535 - protein, 578 aa, Homo sapiens [sequence omitted]

SEQ ID NO: 825536 - protein, 484 aa, Homo sapiens [sequence omitted]

SEQ ID NO: 825537 - protein, 641 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSPEASLCPQHRTGAPLGQSEELQPLSQRHPFLPHLGLASRPNGDWSQPCLTCDRAARATSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATAQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 825538 - protein, 584 aa, Homo sapiens; identical to SEQ ID NO: 825531

SEQ ID NO: 825539 - protein, 584 aa, Homo sapiens; identical to SEQ ID NO: 825531

SEQ ID NO: 825540 - protein, 584 aa, Homo sapiens; identical to SEQ ID NO: 825531

SEQ ID NO: 825541 - protein, 584 aa, Homo sapiens; identical to SEQ ID NO: 825531

SEQ ID NO: 825542 - protein, 216 aa, Homo sapiens
MKSCEMPPVIGFCVHPGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 825543 - protein, 417 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATAQSVPKNSDPWAASQQPASSAGKRASDAWGAVSTTKPVSVSGSFELFSNLNGTIKDDFSEFDNLRTSKKTGMYR

SEQ ID NO: 825544 - protein, 413 aa, Homo sapiens
ERPASLPQFAVHPERSGLADSGDGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 825545 - protein, 444 aa, Homo sapiens
ERPASLPQFAVHPERSGLADSGDGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 825546 - protein, 444 aa, Homo sapiens; identical to SEQ ID NO: 825545

SEQ ID NO: 825547 - protein, 514 aa, Homo sapiens
ERPASLPQFAVHPERSGLADSGDGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEEGNDSEEVPEASGPQNDGKELCPPGKPTTSEKIHKTSGPKRGKHAWTHRLRERKQLVVYEEISDPEEDDE

SEQ ID NO: 825548 - protein, 305 aa, Homo sapiens [sequence omitted]

SEQ ID NO: 825549 - protein, 448 aa, Homo sapiens
ERPASLPQFAVHPERSGLADSGDGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQDPKGGNMPGPTDCVRESSWWFMKRSATLRKMTSNSPRGYDTCP

SEQ ID NO: 825550 - protein, 700 aa, Homo sapiens
MSKFILTFGRGGKGRKESFIGGQVFLVSDQAGWAVVAPACNPSTLGGRGGWIMRSSVRDRLRQHGETSSLLKIRKLAGHVGGCLQSQLLEKLRQENCLNPGGRRCSEAEIVPLPSSLGNRVRLCLKKKKKKKKKKKVIRQRTERRENEENKNYYKFQGMKRLYNQGLLTKYSKLDFFNFPSSLRNIFQFVTGNRPFSLDQGYQALAKYKRHSSTLLHLACFFILGSVIYHNFGIVNMSLNTKKNSANKGTVFSMPESTHCPFLNAKDGEMGWNFLDYYLYLNLSEVLNLEDTFQPERVDFGPMFECISHPDWFYLRNRKQNILKYLLFLARSNFQYGLINRPALAHLDLQSWGSIFYPCSPQLTVLRGRNESIRQNLKAVYKFNIFTHGKTSRVTELLTVFAFGKEDSNRGWKFNKSIRCVCTYDILKGKNELFLNHLLNKLSLFFKNVYSPRGENMKGNVSYAKGSEVVKNSFFFSETHLNSFAAALGGCQNHILVEVVSVCQIKEEINHPPPPPVVCNKVAHSKLDFTVTNCVMETKQSSDSPCRMVTGKLTRKLRTRRKATWDKFTVFFFCFFVLFCFLQCLSKRQQSALKCLECILNCYRDKYTIARIFCRTVLLEISNPEAEQQWLSPVIPALWEAEAGRSLEAQEFETSLANMVIPVSTKSTKISWAQWWAPVIPATQEAEAGEAPEPRRRRLQ

SEQ ID NO: 825551 - protein, 98 aa, Homo sapiens
LSLLLLNSRPVDDPTRIYDTALALWIPSLLMSAGEAALSGYCCVAALTLRGVGPCRKDGLQGQLEEMTELESPKCKRQENEQLLDQNQEIRASQRSWV

SEQ ID NO: 825552 - protein, 73 aa, Homo sapiens
GAADGMRRCSLCAFERFRGTCGPPGVQEPSSPSTALGPAGTSSGEPALVRCLLPGPPSCCVTHCGQRWPPPYC

SEQ ID NO: 825553 - protein, 203 aa, Homo sapiens
MRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQVRKANRKGSFHRDWLC

SEQ ID NO: 825554 - protein, 222 aa, Homo sapiens
MRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 825555 - protein, 222 aa, Homo sapiens; identical to SEQ ID NO: 825554

SEQ ID NO: 825556 - protein, 126 aa, Homo sapiens
MADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 825557 - protein, 126 aa, Homo sapiens; identical to SEQ ID NO: 825556

SEQ ID NO: 825558 - protein, 108 aa, Homo sapiens
NSRDRQTVHHLNLHSPPFDNAGSSLLPSLSSGRRAGERPRWQMRLPRLRSLGLVATRSLGRSSARKYQPKIIFEDDRCLAFHDISPQAPNTFSGDTQETYIPDFCGRR

SEQ ID NO: 825559 - protein, 96 aa, Homo sapiens
ILFLGYHQKSGIYVSWVSPTHFLVIPKKHISQISVAEDDDESLLGHLMIVGKKCAADLGLNKGYRMVVNEGSDGGQSVYHVHLHVLGGRQMHWPPG

SEQ ID NO: 825560 - protein, 126 aa, Homo sapiens; identical to SEQ ID NO: 825556

SEQ ID NO: 825561 - protein, 126 aa, Homo sapiens; identical to SEQ ID NO: 825556

SEQ ID NO: 825562 - protein, 126 aa, Homo sapiens; identical to SEQ ID NO: 825556

SEQ ID NO: 825563 - protein, 126 aa, Homo sapiens; identical to SEQ ID NO: 825556

SEQ ID NO: 825564 - protein, 105 aa, Homo sapiens
MRLPRLRSLGLVATRSLGRSSARKYQPPTHFLVIPKKHISQISVAEDDDESLLGHLMIVGKKCAADLGLNKGYRMVVNEGSDGGQSVYHVHLHVLGGRQMHWPPG

SEQ ID NO: 825565 - protein, 105 aa, Homo sapiens; identical to SEQ ID NO: 825564

SEQ ID NO: 825566 - protein, 71 aa, Homo sapiens
NTPQGHSKGWLGLFEPKICGFLPSSEPLLWPPRGREAEMADEIAKAQVARPGGDTIFGKIIRKEIPAQNHF

SEQ ID NO: 825567 - protein, 108 aa, Homo sapiens
TAYDRCTITTNITKHKKFCALLSMTFPLKHPTHFLVIPKKHISQISVAEDDDESLLGHLMIVGKKCAADLGLNKGYRMVVNEGSDGGQSVYHVHLHVLGGRQMHWPPG

SEQ ID NO: 825568 - protein, 126 aa, Homo sapiens; identical to SEQ ID NO: 825556

SEQ ID NO: 825569 - protein, 126 aa, Homo sapiens; identical to SEQ ID NO: 825556

SEQ ID NO: 825570 - protein, 126 aa, Homo sapiens; identical to SEQ ID NO: 825556

SEQ ID NO: 825571 - protein, 126 aa, Homo sapiens; identical to SEQ ID NO: 825556

SEQ ID NO: 825572 - protein, 141 aa, Homo sapiens
GGGISNPPKTRFLDSHPNDRGKKSKFSYYSISLAPSPLPTSRLHCPHRPQPREDLARPPSRLRSRSRLCRSDTGKLSQRGKVASQAGQSKANCESLPLHGKNTQIGAGLVRTHTESVSVAKKNRSQAKSSILGDAVELGKE

SEQ ID NO: 825573 - protein, 136 aa, Homo sapiens
QPEGRASPTMAQGTLIRVTPEQPTHAVCVLGTLTQLDICSSAPEDCTSFSINASPGVVVDIAHSPPAKKKSTGSSTWPLDPGVEVTLTMKAASGSTGDQKVQISYYGPKTPPVKALLYLTAVDGVSPCHPGWSAMA

SEQ ID NO: 825574 - protein, 416 aa, Homo sapiens
QPEGRASPTMAQGTLIRVTPEQPTHAVCVLGTLTQLDICSSAPEDCTSFSINASPGVVVDIAHSPPAKKKSTGSSTWPLDPGVEVTLTMKAASGSTGDQKVQISYYGPKTPPVKALLYLTAVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATRGKLSSKCSVVLGPKWPSHYLMVPGGKHNMDFYVEALAFPDTDFPGLITLTISLLDTSNLELPEAVVFQDSVVFRVAPWIMTPNTQPPQEVYACSIFENEDFLKSVTTLAMKAKCKLTICPEEENMDDQWMQDEMEIGYIQAPHKTLPVVFDSPRNRGLKEFPIKRVMVPAWGGEGAQLPKPSCLETPSF

SEQ ID NO: 825575 - protein, 416 aa, Homo sapiens; identical to SEQ ID NO: 825574

SEQ ID NO: 825576 - protein, 221 aa, Homo sapiens
MHQALQDFLSAQQVQAPVKLYSDWLSVGHVDEFLSFVPAPDRKGFRLLLASPRSCYKLFQEQQNEGHGEALLFEGIKKKKQQKIKNILSNKTLREHNSFVERCIDWNRELLKRELGLAESDIIDIPQLFKLKEFSKAEAFFPNMVNMLVLGKHLGIPKPFGPVINGRCCLEEKVCSLLEPLGLQCTFINDFFTYHIRHGEVHCGTNVRRKPFSFKWWNMVP

SEQ ID NO: 825577 - protein, 275 aa, Homo sapiens
QPEGRASPTMAQGTLIRVTPEQPTHAVCVLGTLTQLDICSSAPEDCTSFSINASPGVVVDIAHSPPAKKKSTGSSTWPLDPGVEVTLTMKAASGSTGDQKVQISYYGPKTPPVKALLYLTAVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATQGAPGSRCPGKRGPPRRSPCCAFHRGPSGSERATWTQDYAALGDSSPLA

SEQ ID NO: 825578 - protein, 672 aa, Homo sapiens
QPEGRASPTMAQGTLIRVTPEQPTHAVCVLGTLTQLDICSSAPEDCTSFSINASPGVVVDIAHSPPAKKKSTGSSTWPLDPGVEVTLTMKAASGSTGDQKVQISYYGPKTPPVKALLYLTAVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATRGKLSSKCSVVLGPKWPSHYLMVPGGKHNMDFYVEALAFPDTDFPGLITLTISLLDTSNLELPEAVVFQDSVVFRVAPWIMTPNTQPPQEVYACSIFENEDFLKSVTTLAMKAKCKLTICPEEENMDDQWMQDEMEIGYIQAPHKTLPVVFDSPRNRGLKEFPIKRVMGPDFGYVTRGPQTGGISGLDSFGNLEVSPPVTVRGKEYPLGRILFGDSCYPSNDSRQMHQALQDFLSAQQVQAPVKLYSDWLSVGHVDEFLSFVPAPDRKGFRLLLASPRSCYKLFQEQQNEGHGEALLFEGIKKKKQQKIKNILSNKTLREHNSFVERCIDWNRELLKRELGLAESDIIDIPQLFKLKEFSKAEAFFPNMVNMLVLGKHLGIPKPFGPVINGRCCLEEKVCSLLEPLGLQCTFINDFFTYHIRHGEVHCGTNVRRKPFSFKWWNMVP

SEQ ID NO: 825579 - protein, 136 aa, Homo sapiens; identical to SEQ ID NO: 825573

SEQ ID NO: 825580 - protein, 612 aa, Homo sapiens
QPEGRASPTMAQGTLIRVTPEQPTHAVCVLGTLTQLDICSSAPEDCTSFSINASPGVVVDIAHSPPAKKKSTGSSTWPLDPGVEVTLTMKAASGSTGDQKVQISYYGPKTPPVKALLYLTAVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATRAPRGCGVPRQRVFRVAPWIMTPNTQPPQEVYACSIFENEDFLKSVTTLAMKAKCKLTICPEEENMDDQWMQDEMEIGYIQAPHKTLPVVFDSPRNRGLKEFPIKRVMGPDFGYVTRGPQTGGISGLDSFGNLEVSPPVTVRGKEYPLGRILFGDSCYPSNDSRQMHQALQDFLSAQQVQAPVKLYSDWLSVGHVDEFLSFVPAPDRKGFRLLLASPRSCYKLFQEQQNEGHGEALLFEGIKKKKQQKIKNILSNKTLREHNSFVERCIDWNRELLKRELGLAESDIIDIPQLFKLKEFSKAEAFFPNMVNMLVLGKHLGIPKPFGPVINGRCCLEEKVCSLLEPLGLQCTFINDFFTYHIRHGEVHCGTNVRRKPFSFKWWNMVP

SEQ ID NO: 825581 - protein, 237 aa, Homo sapiens
QPEGRASPTMAQGTLIRVTPEQPTHAVCVLGTLTQLDICSSAPEDCTSFSINASPGVVVDIAHSPPAKKKSTGSSTWPLDPGVEVTLTMKAASGSTGDQKVQISYYGPKTPPVKALLYLTAVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATHGQSEGVSGHT

SEQ ID NO: 825582 - protein, 109 aa, Homo sapiens [sequence omitted]

SEQ ID NO: 825583 - protein, 358 aa, Homo sapiens
MEAPGLAQAAAAESDSRKVAEETPDGAPALCPSPEALSPEPPVYSLQDFDTLATVGTGTFGRVHLVKEKTAKHFFALKVMSIPDVIRLKQEQHVHNEKSVLKEVSHPFLIRLFWTWHDERFLYMLMEYVPGGELFSYLRNRGRFSSTTGLFYSAEIICAIEYLHSKEIVYRDLKPENILLDRDGHIKLTDFGFAKKLVDRTWTLCGTPEYLAPEVIQSKGHGRAVDWWALGILIFEMLSGFPPFFDDNPFGIYQKILAGKIDFPRHLDFHVKDLIKKLLVVDRTRRLGNMKNGANDVKHHRWFRSVDWEAVPQRKLKPPIVPKIAGDGDTSNFETYPENDWDTAAPVPQKDLEIFKNF

SEQ ID NO: 825584 - protein, 358 aa, Homo sapiens; identical to SEQ ID NO: 825583

SEQ ID NO: 825585 - protein, 358 aa, Homo sapiens; identical to SEQ ID NO: 825583

SEQ ID NO: 825586 - protein, 358 aa, Homo sapiens; identical to SEQ ID NO: 825583

SEQ ID NO: 825587 - protein, 358 aa, Homo sapiens; identical to SEQ ID NO: 825583

SEQ ID NO: 825588 - protein, 358 aa, Homo sapiens; identical to SEQ ID NO: 825583

SEQ ID NO: 825589 - protein, 103 aa, Homo sapiens
MGDQVPREQDLAKRSSPGPSPVLNMCNRQSAWATALSPWYCMHAMLAAPFPSWAPRVSPDPGSQVCSHLHLPHSPPLLVPDTSTPTWSSPIAHKRGGTRDELS

SEQ ID NO: 825590 - protein, 197 aa, Homo sapiens
MMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825591 - protein, 197 aa, Homo sapiens; identical to SEQ ID NO: 825590

SEQ ID NO: 825592 - protein, 245 aa, Homo sapiens
QKLCIVRARCNIGRGRSSLYKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825593 - protein, 197 aa, Homo sapiens; identical to SEQ ID NO: 825590

SEQ ID NO: 825594 - protein, 197 aa, Homo sapiens; identical to SEQ ID NO: 825590

SEQ ID NO: 825595 - protein, 215 aa, Homo sapiens
DGIFKAELNEFLTRELAEDGYLELRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825596 - protein, 204 aa, Homo sapiens
FSWIVKEFQVTLIWHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825597 - protein, 197 aa, Homo sapiens; identical to SEQ ID NO: 825590

SEQ ID NO: 825598 - protein, 197 aa, Homo sapiens; identical to SEQ ID NO: 825590

SEQ ID NO: 825599 - protein, 345 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMVTSLRPQYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825600 - protein, 160 aa, Homo sapiens
DVFTQPVNRLLAWYSLMKDGPVASFTGTVSFVTSGARPVLEAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825601 - protein, 197 aa, Homo sapiens; identical to SEQ ID NO: 825590

SEQ ID NO: 825602 - protein, 197 aa, Homo sapiens; identical to SEQ ID NO: 825590

SEQ ID NO: 825603 - protein, 314 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825604 - protein, 197 aa, Homo sapiens; identical to SEQ ID NO: 825590

SEQ ID NO: 825605 - protein, 197 aa, Homo sapiens; identical to SEQ ID NO: 825590

SEQ ID NO: 825606 - protein, 197 aa, Homo sapiens; identical to SEQ ID NO: 825590

SEQ ID NO: 825607 - protein, 283 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRSQGSKTSRSAAAPALPPF

SEQ ID NO: 825608 - protein, 103 aa, Homo sapiens; identical to SEQ ID NO: 825589

SEQ ID NO: 825609 - protein, 214 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSSPAAWLGGYLP

SEQ ID NO: 825610 - protein, 170 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTFPRFEHV

SEQ ID NO: 825611 - protein, 87 aa, Homo sapiens
QADCRLHMFKTGEGPGATALSPWYCMHAMLAAPFPSWAPRVSPDPGSQVCSHLHLPHSPPLLVPDTSTPTWSSPIAHKRGGTRDELS

SEQ ID NO: 825612 - protein, 270 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRSMYGD

SEQ ID NO: 825613 - protein, 344 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQRAGAGRAGRGRRKRARPGAGGGGGPGSCRSAPGQRRG

SEQ ID NO: 825614 - protein, 261 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMVTSLRPQVQCWGRATGPSTSPPPRAAAPSTPATSPGKREDRGLFSIQPAPAGLSLPR

SEQ ID NO: 825615 - protein, 391 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825616 - protein, 197 aa, Homo sapiens; identical to SEQ ID NO: 825590

SEQ ID NO: 825617 - protein, 197 aa, Homo sapiens; identical to SEQ ID NO: 825590

SEQ ID NO: 825618 - protein, 262 aa, Homo sapiens
GGITAAFLHNRNILYVSSCLYVSLLCLSESRAKVTEHVRGTRPGRATAGPAASTRAAGSLFFDRWGNRGPAGCRGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825619 - protein, 264 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825620 - protein, 197 aa, Homo sapiens; identical to SEQ ID NO: 825590

SEQ ID NO: 825621 - protein, 197 aa, Homo sapiens; identical to SEQ ID NO: 825590

SEQ ID NO: 825622 - protein, 197 aa, Homo sapiens; identical to SEQ ID NO: 825590

SEQ ID NO: 825623 - protein, 159 aa, Homo sapiens
PARIPAAPARIPAANSCCSRENSCCSREMSCCLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 825624 - protein, 197 aa, Homo sapiens; identical to SEQ ID NO: 825590

SEQ ID NO: 825625 - protein, 197 aa, Homo sapiens; identical to SEQ ID NO: 825590

SEQ ID NO: 825626 - protein, 261 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQARRERNV

SEQ ID NO: 825627 - protein, 246 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGRRRGPQPSLQATSSFLPTPFPASLLLPCSLVRWIPALTCEAS

SEQ ID NO: 825628 - protein, 235 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLP

SEQ ID NO: 825629 - protein, 343 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQATALSPWYCMHAMLAAPFPSWAPRVSPDPGSQVCSHLHLPHSPPLLVPDTSTPTWSSPIAHKRGGTRDELS

SEQ ID NO: 825630 - protein, 224 aa, Homo sapiens
DHDVRAPARGGGGTSEPGKKNGLALEYGFSKCNLGPTDLCDYVRGVRFYNKIKMLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSSPPTPGPRYAPTSTCPTHHLC

SEQ ID NO: 825631 - protein, 326 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEVRARALGRGCEGAPHLPSPCPLQPSWVVCWAPQGTRLPSLDLPGSEHQSRPVQKNPRARDTPGVQACGGRASPCSGIPSWSESCHR

SEQ ID NO: 825632 - protein, 183 aa, Homo sapiens
MLVQYRVSPPGAVDMMFPQSRHSGSSHLPQQLKFTTSDSCDRIKDEFQLLQAQYHSLKLECDKLASEKSEMQRHYVMYYEMSCCLNIEMHKQAEIVKRLNAAAAPGAADRRRDKGAAARRPQQPEPGRTAGAQPAPPAAIDMMFPQSRHSGSSHLPQQLKFTTSDSCDRIKDEFQLLQAQYHR

SEQ ID NO: 825633 - protein, 464 aa, Homo sapiens [sequence omitted]

SEQ ID NO: 825634 - protein, 464 aa, Homo sapiens [sequence omitted]

SEQ ID NO: 825635 - protein, 464 aa, Homo sapiens [sequence omitted]

SEQ ID NO: 825636 - protein, 316 aa, Homo sapiens
MLRRYRPDITSCHGSTAESKGGVVLDVSGRARPLRRTRNSPSPTSLTSSKMSGLDGGNKLPLAQTGGLAAPDHASGDPDLDQCQGLREETEATQVMANTGGGSLETVAEGGASQDPVDCGPALRVPVAGSRGGAATKAGQEDAPPSTKGLEAASAAEAADSSQKNGCQLGEPRGPAGQKALEACGAGGLGSQMIPGKKAKEVTTKKRAISAAVEKEGEAGAAMEEKKVVQKEKKVAGGVKEETRPRAPKINNCMDSLEAIDQELSNVNAQADRAFLQLERKFGRMRRLHMQRRSFIIQNIPGFWVTAFHSEAVLAY

SEQ ID NO: 825637 - protein, 708 aa, Homo sapiens [sequence omitted]

SEQ ID NO: 825638 - protein, 708 aa, Homo sapiens [sequence omitted]

SEQ ID NO: 825639 - protein, 708 aa, Homo sapiens [sequence omitted]

SEQ ID NO: 825640 - protein, 708 aa, Homo sapiens [sequence omitted]

SEQ ID NO: 825641 - protein, 708 aa, Homo sapiens [sequence omitted]

SEQ ID NO: 825642 - protein, 693 aa, Homo sapiens
MSQYTEKEPAAMDQESGKAVWPKPAGGYQTITGRRYGRRHAYVSFKPCMTRHERSLGRAGDDYEVLELDDVPKENSSGSSPLDQVDSSLPSEPIFEKSETEIPTCGSALNQTTESSQSFVAVHHSEEGRDTLGSSTNLHNHSEGEYIPGACSASSVQNGIALVHTDSYDPDGKHGEDNDHLQLSAEVVEGSRYQESLGNTVFELENREAEAYTGLSPPVPSFNCEVRDEFEELDSVPLVKSSAGDTEFVHQNSQEIQRSSQDEMVSTKQQNNTSQERQTEHSPEDAACGPGHICSERNTNDREKNHGSSPEQVVRPKVRKLISSSQVDQETGFNRHEAKQRSVQRWREALEVEESGSDDLLIKCEEYDGEHDCMFLDPPYSRVITQRETENNQMTSESGATAGRQEVDNTFWNGCGDYYQLYDKDEDSSECSDGEWSASLPHRFSGTEKDQSSSDESWETLPGKDENEPELQSDSSGPEEENQELSLQEGEQTSLEEGEIPWLQYNEVNESSSDEGNEPANEFAQPAFMLDGNNNLEDDSSVSEDLDVDWSLFDGFADGLGVAEAISYVDPQFLTYMALEERLAQAMETALAHLESLAVDVEVANPPASKESIDGLPETLVLEDHTAIGQEQCCPICCSEYIKDDIATELPCHHFFHKPCVSIWLQKHLQLLPLSLILMPHLQMTVLQKHPKP

SEQ ID NO: 825643 - protein, 708 aa, Homo sapiens [sequence omitted]

SEQ ID NO: 825644 - protein, 708 aa, Homo sapiens [sequence omitted]

SEQ ID NO: 825645 - protein, 693 aa, Homo sapiens; identical to SEQ ID NO: 825642

SEQ ID NO: 825646 - protein, 406 aa, Homo sapiens
MSQYTEKEPAAMDQESGKAVWPKPAGGYQTITGRRYGRRHAYVSFKPCMTRHERSLGRAGDDYEVLELDDVPKENSSGSSPLDQVDSSLPSEPIFEKSETEIPTCGSALNQTTESSQSFVAVHHSEEGRDTLGSSTNLHNHSEGEYIPGACSASSVQNGIALVHTDSYDPDGKHGEDNDHLQLSAEVVEGSRYQESLGNTVFELENREAEAYTGLSPPVPSFNCEVRDEFEELDSVPLVKSSAGDTEFVHQNSQEIQRSSQDEMVSTKQQNNTSQERQTEHSPEDAACGPGHICSERNTNDREKNHGSSPEQVVRPKVRKLISSSQVDQETGFNRHEAKQRSVQRWREALEVEESGSDDLLIKCEEYDGEHEHRLIFKIKIFLTWVSLLKNQCISHKTPSLRIIEQ

SEQ ID NO: 825647 - protein, 334 aa, Homo sapiens
MNDPDVQAQVQVLSAALRAAQLDCVNEAESKPTAGLKEVSISHPSSASDNQIALAASSSQDELFVARILQSPDPGGPRNGTSDHLETDQRQDPTPLEENKSKLQDVIPQPLLDQYVSMTDPARAQTVDTDIAKHCAYSLPGVALTLGRQNWHCLKDTYETLASDVQWKVRRALAFSIHELAVILGDQLTAADLVPIFNGFLKDLDEVRIGVLRHLYDFLKLLHEDKRRDYLYQLQEFVVTDNSRNWRFRYELAEQLILILELYSPNDVYDYLMHIALKLCADQVSEVRWISFKLVRNQGICSVIFTNRNVDVSSILTLLIFLGLLCQLTYETSF

SEQ ID NO: 825648 - protein, 182 aa, Homo sapiens [sequence omitted]

SEQ ID NO: 825649 - protein, 342 aa, Homo sapiens [sequence omitted]

SEQ ID NO: 825650 - protein, 73 aa, Homo sapiens
PWGRAADPYKQPAGRSLGLWLVCGFRLEDSLGRWPALVETASPRRWRREIIAAPTCWLQRLQVWKNSCKDGEK

SEQ ID NO: 825651 - protein, 73 aa, Homo sapiens; identical to SEQ ID NO: 825650

SEQ ID NO: 825652 - protein, 203 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 825653 - protein, 203 aa, Homo sapiens; identical to SEQ ID NO: 825652

SEQ ID NO: 825654 - protein, 158 aa, Homo sapiens
MGKSLVSTCHHGIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 825655 - protein, 199 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIAKPTWNHFEVHWNGQEGDKQTSQTKRKEKRMIHLL

SEQ ID NO: 825656 - protein, 68 aa, Homo sapiens
PWGRAADPYKQPAGRSLGLWLVCGFRLEDSLGRWPALVETASPRRWRREIIAAPTCWLQRLQVWKNDH

SEQ ID NO: 825657 - protein, 162 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMQQQRFHEICSNLVKTRRRAVGRWKRL

SEQ ID NO: 825658 - protein, 175 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIDPNPGISGTFP

SEQ ID NO: 825659 - protein, 203 aa, Homo sapiens; identical to SEQ ID NO: 825652

SEQ ID NO: 825660 - protein, 203 aa, Homo sapiens; identical to SEQ ID NO: 825652

SEQ ID NO: 825661 - protein, 194 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMGGTTSPQPASHLPDSDFLTIASWTKPTWNHFEVHWNGQEGDKQTSQTKRKEKRMIHLL

SEQ ID NO: 825662 - protein, 83 aa, Homo sapiens
AKPMRWWRGLFTLSGRGPYYVLYSESLSRCTSLAVGIALPISETNDVRDETIVSCYLDLNPRLVPFIGLVFHGHLSTWNSFGL

SEQ ID NO: 825663 - protein, 142 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMMVLFLL

SEQ ID NO: 825664 - protein, 95 aa, Homo sapiens
AFLCGITMAAGTLYTYPENWRAFKALIAAQYSGAQVRVLSAPPHFHFGQTNRTPEFLRKFPAGKVPAFEGDDGFCVFESNAIAYYVSNEECWMLT

SEQ ID NO: 825665 - protein, 409 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825666 - protein, 317 aa, Homo sapiens [sequence omitted]

SEQ ID NO: 825667 - protein, 316 aa, Homo sapiens
AFLCGITMAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825668 - protein, 454 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGTFNGQPTNHNRGTVQNVATEREMRAEIYSGGMHGMPYFEKHRREFYLGGAKHERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825669 - protein, 380 aa, Homo sapiens
LGHLLTQFHFPQDSPELGHRFMQMRKHANGIVVRPAGKKALEPAYESHNRVQTTVMSANVTGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825670 - protein, 359 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSEGLSEFFREAILLSTTG

SEQ ID NO: 825671 - protein, 400 aa, Homo sapiens
AFLCGITMAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLLMLKSLQRPNLKRTHHGKRRVHGKRSRSPRLSEKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825672 - protein, 111 aa, Homo sapiens
DTNLCAIHAKRVTIMPKDIQLARRIRGERDLRIHYDGKHFILKKKKKLETERGQELAFPLSPDWQVDYESYTWRKLDPGSEETQTLVREYFSWEGAFQHVGKAFNQGKIFK

SEQ ID NO: 825673 - protein, 437 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825674 - protein, 321 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825675 - protein, 420 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 825676 - protein, 225 aa, Homo sapiens [sequence omitted]

SEQ ID NO: 825677 - protein, 225 aa, Homo sapiens [sequence omitted]

SEQ ID NO: 825678 - protein, 224 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAIT

SEQ ID NO: 825679 - protein, 836 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 825680 - protein, 206 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKALVSGVSSH

SEQ ID NO: 825681 - protein, 186 aa, Homo sapiens
MPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 825682 - protein, 479 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 825683 - protein, 103 aa, Homo sapiens
MRIGQKTAKLRAAVLCFLFSSSDFSLASLFHLPTVSTPLGQGRVNQLGGVFINGRPLPNHIRHKIVEMAHHGIRPCVISRQLRVSHGCVSKILCRYQETGSIR

SEQ ID NO: 825684 - protein, 215 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKRWRLGRRTCWVTWRASAS

SEQ ID NO: 825685 - protein, 484 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 825686 - protein, 391 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFSPLSPGVWNLPPRCRPAAVRD

SEQ ID NO: 825687 - protein, 911 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 825688 - protein, 911 aa, Homo sapiens; identical to SEQ ID NO: 825687

SEQ ID NO: 825689 - protein, 797 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGSGDKWSNKQLFLDAIHPTEAIFSEDRNTMEPVHKVKNIPSIFNTLHDQRSFLFLSFVFLCQH

SEQ ID NO: 825690 - protein, 483 aa, Homo sapiens
MDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGPFQSQKKNLFHKIVSKYKHKKEKPNVPEKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 825691 - protein, 108 aa, Homo sapiens
HGLNPVTSHGASSEQGPRKRRPPWLSSTALSQLQLAPELTQGELQRELEDATETADAMNREVSSLKNKLRRGDLPFVVPRRMARKGAGDGSDEEVDGKADGAEAKPAE

SEQ ID NO: 825692 - protein, 87 aa, Homo sapiens
RPSSYLPTEAKLKKLEEEQIILEDQNCKLAKDKKLEDGKMMADYGIRKGNLLFLASFVLEGDHPGHGVLAGVKKLISFNLLLNEHIF

SEQ ID NO: 825693 - protein, 54 aa, Homo sapiens
MSPRLVTNSWAPAILLPQPPKVLGITGMSHCARPFLIFSRDKVFTILAQADLPG

SEQ ID NO: 825694 - protein, 1855 aa, Homo sapiens
GSRADTFVEKVMQEQGTHPKFQKPKQLKDKADFCIIHYAGKVDYKADEWLMKNMDPLNDNIATLLHQSSDKSVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGSPTGWSSRSFGRADLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825695 - protein, 1751 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825696 - protein, 1271 aa, Homo sapiens
MGCIVGQYRSPNEYRRHSFSNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825697 - protein, 1659 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825698 - protein, 1726 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGREKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825699 - protein, 986 aa, Homo sapiens
TAAMDAIKMKMQMLKLDKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825700 - protein, 1548 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825701 - protein, 1751 aa, Homo sapiens; identical to SEQ ID NO: 825695

SEQ ID NO: 825702 - protein, 1751 aa, Homo sapiens; identical to SEQ ID NO: 825695

SEQ ID NO: 825703 - protein, 1751 aa, Homo sapiens; identical to SEQ ID NO: 825695

SEQ ID NO: 825704 - protein, 817 aa, Homo sapiens
LQCDLEDPQRWSQLQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825705 - protein, 963 aa, Homo sapiens
LLLLQCTRKRRSSRPPGRVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVRPPPGPWCGQWALAAVVAQVPRCMCALCLSLFSNWLSDPHGSACDSGPALPKGDEVGQEQWGWVHGPSVSPRPVQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825706 - protein, 515 aa, Homo sapiens
ACRLTSNRSLASSVACSSSSSSSSCVFISSTKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825707 - protein, 1751 aa, Homo sapiens; identical to SEQ ID NO: 825695

SEQ ID NO: 825708 - protein, 1582 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAPAQNLIPKRQGPGPGRERPAGSSALSCQKAQDVEASRAGPRGGARVFYESIFLQTEAFW

SEQ ID NO: 825709 - protein, 1751 aa, Homo sapiens; identical to SEQ ID NO: 825695

SEQ ID NO: 825710 - protein, 1751 aa, Homo sapiens; identical to SEQ ID NO: 825695

SEQ ID NO: 825711 - protein, 1631 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKGQRPSQAILCLL

SEQ ID NO: 825712 - protein, 1402 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERQRHCPLSPS

SEQ ID NO: 825713 - protein, 118 aa, Homo sapiens
LVLGLVLDRELRTSNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825714 - protein, 1738 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLSPQKLGLSQPHAQQCQPCPEPKGSPR

SEQ ID NO: 825715 - protein, 1591 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQGALVAWPFLDRLKS

SEQ ID NO: 825716 - protein, 1448 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAPDDRTCMRESRD

SEQ ID NO: 825717 - protein, 1392 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDAMLTAMGTTKPALRGPTKPTVNYK

SEQ ID NO: 825718 - protein, 118 aa, Homo sapiens; identical to SEQ ID NO: 825713

SEQ ID NO: 825719 - protein, 1196 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVATWTRRWRTCGCRDLLGGKQELPRRGPDRARQGALKGET

SEQ ID NO: 825720 - protein, 995 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKGEQEVTILIPGSPSDPLFSDSARPGWGRGWPSPTAAPLPS

SEQ ID NO: 825721 - protein, 631 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVRARRAS

SEQ ID NO: 825722 - protein, 588 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARK

SEQ ID NO: 825723 - protein, 390 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVRSTHGEVLARSSQERWSRANCW

SEQ ID NO: 825724 - protein, 348 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPARIPLAPARIPLAPARIPLAPARIPLAPARIPLAPARIP

SEQ ID NO: 825725 - protein, 98 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLCGACVVMIEPRSQI

SEQ ID NO: 825726 - protein, 49 aa, Homo sapiens
MLTRLCHRPPSRQGRLGSPGRCPAFTASLGSLQGELERQLLQANPILEA

SEQ ID NO: 825727 - protein, 42 aa, Homo sapiens
RNKAEKQKRDLGEELEALKTELEDTLDSTAAQQELRCALGPS

SEQ ID NO: 825728 - protein, 142 aa, Homo sapiens [sequence omitted]

SEQ ID NO: 825729 - protein, 76 aa, Homo sapiens
EKFDCLKPSSLNSSKSFSIQLCSVAGEELREKTLEEEAKTHEAQIQEMRQKHSQAVEELAEQLEQTKRVRSLPETA

SEQ ID NO: 825730 - protein, 1751 aa, Homo sapiens; identical to SEQ ID NO: 825695

SEQ ID NO: 825731 - protein, 1751 aa, Homo sapiens; identical to SEQ ID NO: 825695

SEQ ID NO: 825732 - protein, 1827 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVRPPPGPWCGQWALAAVVAQVPRCMCALCLSLFSNWLSDPHGSACDSGPALPKGDEVGQEQWGWVHGPSVSPRPVQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825733 - protein, 1751 aa, Homo sapiens; identical to SEQ ID NO: 825695

SEQ ID NO: 825734 - protein, 944 aa, Homo sapiens
HEAQIQEMRQKHSQAVEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825735 - protein, 535 aa, Homo sapiens
GLQVDLQPQLGIFGGLQLVLQLFQLRLPPPISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825736 - protein, 1751 aa, Homo sapiens; identical to SEQ ID NO: 825695

SEQ ID NO: 825737 - protein, 1751 aa, Homo sapiens; identical to SEQ ID NO: 825695

SEQ ID NO: 825738 - protein, 1343 aa, Homo sapiens
MTNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTAPSPHPVSLQVLLRAFGFLCCIPFQLPPLLRI

SEQ ID NO: 825739 - protein, 222 aa, Homo sapiens
PRVRTCPKSDSQSVRGASLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825740 - protein, 141 aa, Homo sapiens
GIRGSLEAKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 825741 - protein, 1751 aa, Homo sapiens; identical to SEQ ID NO: 825695

SEQ ID NO: 825742 - protein, 1660 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQVWALV

SEQ ID NO: 825743 - protein, 1021 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQPASATARLSGSSWKGQQPSSGFSQHSWGPNIFNG

SEQ ID NO: 825744 - protein, 1415 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDESKPREGKADLENERGELANEVKVLLQGKGDSEHSTIKWRPGSSRSP

SEQ ID NO: 825745 - protein, 215 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKDGFLPTLSQAAPLSAVSLLILKCLKCNAPSPPLPRTACLCHSKAVGVKLERPAAFQWLLPTLLGTKYI

SEQ ID NO: 825746 - protein, 1213 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVWRPGGPAGLCRLGSCWPGTGLGTAGQPCPLGRPIAALPLGSQPCSPTSVLSRKGIQ

SEQ ID NO: 825747 - protein, 748 aa, Homo sapiens
MTNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQANFCKHKGKRIRPSKSMNAFITPSANNTYNTAGTPLWTNPL

SEQ ID NO: 825748 - protein, 612 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLQQRLDLGEEPPPLPVPQLQVGSAVPLEDLHGGKLLLPLGKCFPGQVAPAA

SEQ ID NO: 825749 - protein, 322 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPAFLITEIFY

SEQ ID NO: 825750 - protein, 194 aa, Homo sapiens
PDIRSVGDSKTYGYAKTVKNENSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTGNTRGLSLEIMGQVLGHGFAQEGRSCGNSGHYSF

SEQ ID NO: 825751 - protein, 136 aa, Homo sapiens
ARTLVRAVGPSSSCGPGPQVHVCSLSLSLLKLAPQTLMVQLVTQVQLYLKEMRWGRSSGGGSMVLCVSPPGAGGAGQRDRASQPVRQQVQQAHQGLLRAGVPAAGHSGRGGARFPEGGPLQKGLCVHATLASEPIG

SEQ ID NO: 825752 - protein, 846 aa, Homo sapiens
RSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 825753 - protein, 683 aa, Homo sapiens
QRPFWPGDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 825754 - protein, 298 aa, Homo sapiens [sequence omitted]

SEQ ID NO: 825755 - protein, 846 aa, Homo sapiens; identical to SEQ ID NO: 825752

SEQ ID NO: 825756 - protein, 846 aa, Homo sapiens; identical to SEQ ID NO: 825752

SEQ ID NO: 825757 - protein, 729 aa, Homo sapiens
MFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 825758 - protein, 150 aa, Homo sapiens
MFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERKERVLSLQG

SEQ ID NO: 825759 - protein, 729 aa, Homo sapiens; identical to SEQ ID NO: 825757

SEQ ID NO: 825760 - protein, 846 aa, Homo sapiens; identical to SEQ ID NO: 825752

SEQ ID NO: 825761 - protein, 356 aa, Homo sapiens
MSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 825762 - protein, 480 aa, Homo sapiens
MFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKGHRPWRSSSEAPSE

SEQ ID NO: 825763 - protein, 792 aa, Homo sapiens
MQGEDARYLKRKVKGGNIDVHPSEKALIVHYEVEATILGEMGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 825764 - protein, 807 aa, Homo sapiens
MALIASGYGLLGPHWPFDGIPKAITRKVKGGNIDVHPSEKALIVHYEVEATILGEMGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 825765 - protein, 772 aa, Homo sapiens
MQGEDARYLKRKVKGGNIDVHPSEKALIVHYEVEATILGEMGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSTFHPRISKCFTNTH

SEQ ID NO: 825766 - protein, 792 aa, Homo sapiens; identical to SEQ ID NO: 825763

SEQ ID NO: 825767 - protein, 792 aa, Homo sapiens; identical to SEQ ID NO: 825763

SEQ ID NO: 825768 - protein, 697 aa, Homo sapiens
MQGEDARYLKRKVKGGNIDVHPSEKALIVHYEVEATILGEMGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVEIIKPHLDAK

SEQ ID NO: 825769 - protein, 580 aa, Homo sapiens
RRRRCRAVARAPRHLRQFPSGPSRHFLAACVARWLRGSVLVSEALSGSAMDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 825770 - protein, 302 aa, Homo sapiens
MLYSLLQALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 825771 - protein, 547 aa, Homo sapiens
APPLSVGYVDDTPVRALRQRVTEGAAGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 825772 - protein, 580 aa, Homo sapiens; identical to SEQ ID NO: 825769

SEQ ID NO: 825773 - protein, 505 aa, Homo sapiens
NQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPVSMSSCTSTGSQRR

SEQ ID NO: 825774 - protein, 703 aa, Homo sapiens
NQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAK

SEQ ID NO: 825775 - protein, 78 aa, Homo sapiens
MALVEWGADIKIPKNVGVTLDLGNRQSRNSFGAQASGRELAHLEDSDQARKFLFLADVLQWRAHTTPDHPLFLLLNAK

SEQ ID NO: 825776 - protein, 534 aa, Homo sapiens
NQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 825777 - protein, 781 aa, Homo sapiens
MSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 825778 - protein, 816 aa, Homo sapiens
MSSECDGGSKAVMNGLAPGSNGQDKDMDPTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 825779 - protein, 533 aa, Homo sapiens
MISSSSVHSRTFNTSNALGPVCKHKKPLSAAKACISEILPSKFKPRLSAPSALLQEQKSILLPSEKAQSCENLCVSGSLNDSKRGLPLQVGGSIENLLMRSRRDYDSKSSSTMSLQEYSTSGRRPCPLSRKAGMQFTMLYRDMHQINRSGLFLGSISSSSSVRDLASHFEKSSLALSRGELGPSQEGSEHIPKHTVSSRITAFEQLIQRSRSMPSLDLSGRLSKSPTPVLSRGSLTSARSAESLLESTKLHPKEMDGMNSSGVYASPTCSNMAHHALSFRGLVPSEPLSTCSDDVDRCSNISTDSREGSGGSVHGDFPKHRLNKCKGTCPASYTRFTTIRKHEQQQTSRQPEWRLDARGDKSTLLRNIYLMSPLPFRLKKPLHHHPRQPSPGDSSGLLVGQKPDLPSQPHQDQPPSGGKPVVPTRLSSRHTMARLSRSSEPSQERPTALEDYPRAINNGNSVPYSDHSLDRNNNPQSELAPSRGGGILCVCLVSPARPSTLLALSRPPLCPWCSFSGLSFVFCLFCLAINHGS

SEQ ID NO: 825780 - protein, 851 aa, Homo sapiens
CCSDLEDPDGGRRPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 825781 - protein, 1161 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 825782 - protein, 1161 aa, Homo sapiens; identical to SEQ ID NO: 825781

SEQ ID NO: 825783 - protein, 1161 aa, Homo sapiens; identical to SEQ ID NO: 825781

SEQ ID NO: 825784 - protein, 590 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNRGKRGLCPTPSPLEST

SEQ ID NO: 825785 - protein, 799 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMVMCILKLFCLTVPMFFNQNALCSWITFFPLEIDLTLF

SEQ ID NO: 825786 - protein, 838 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKGN

SEQ ID NO: 825787 - protein, 554 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTVSLLDSPPHGFSECLLPAVTFPFSLKH

SEQ ID NO: 825788 - protein, 35 aa, Homo sapiens
MGESNGRRGGCYLPGSGEISGRKRFSDSLVDLVSK

SEQ ID NO: 825789 - protein, 265 aa, Homo sapiens
MSSECDGGSKAVMNGLAPGSNGQDKDMDPTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTVSLLDSPPHGFSECLLPAVTFPFSLKH

SEQ ID NO: 825790 - protein, 1161 aa, Homo sapiens; identical to SEQ ID NO: 825781

SEQ ID NO: 825791 - protein, 1038 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 825792 - protein, 1161 aa, Homo sapiens; identical to SEQ ID NO: 825781

SEQ ID NO: 825793 - protein, 1161 aa, Homo sapiens; identical to SEQ ID NO: 825781

SEQ ID NO: 825794 - protein, 928 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEKKKKKKK

SEQ ID NO: 825795 - protein, 805 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRVSIYGERKKWQRVEE

SEQ ID NO: 825796 - protein, 554 aa, Homo sapiens; identical to SEQ ID NO: 825787

SEQ ID NO: 825797 - protein, 444 aa, Homo sapiens
EEASFMNRSLQTTCPATTMSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQVLSPPRPPLPQKDRFAWQSPTIHNTYKDSLYLSSPKPYVPLGTPRQQNPSQPQPISVLLAAGSAPKGVVCPGSLLPDSTFPSASSQPQQRYAATRTVYHKNVSSNPCHEAVGIKKVSSLYVPCLSNNICLAASENSSRVARDPAEGTPLEAAGTRAPAPGLVSRTAGTGKPPPAPPPDPPKLFFDIRKDAVNRGESPSLGTQASFPDVRPPVLGPRVTSDPENRKSKESYLLQPSYPAKDATSSSAAQPEVIVVPLYLVNTDRGQEGRAVAGIVGTQPR

SEQ ID NO: 825798 - protein, 104 aa, Homo sapiens
MAGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 825799 - protein, 104 aa, Homo sapiens; identical to SEQ ID NO: 825798

SEQ ID NO: 825800 - protein, 104 aa, Homo sapiens; identical to SEQ ID NO: 825798

SEQ ID NO: 825801 - protein, 104 aa, Homo sapiens
MAGKAHRLSAEERDQLLPNLRAVGWNELEGRDAIFKQFHFKDFNRAFGFMTRVALQAEKLDHHPEWFNVYNKVSRLQASGVQQYHLLSWFSSLPTTDLGTCQPP

SEQ ID NO: 825802 - protein, 104 aa, Homo sapiens; identical to SEQ ID NO: 825798

SEQ ID NO: 825803 - protein, 239 aa, Homo sapiens
GGGAYDLPGPGKTVVEESTDLVPLVARFCFILGWEREGGRVCALVCVPVRCPFPLALWVRGLPGTHALRRYAGPRASPRAGLRPVPGHGGLVALEQPSSRELPPPTPGAGAGAGPLLCCKLASFIRPFLVHRPSEQAGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 825804 - protein, 380 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 825805 - protein, 380 aa, Homo sapiens; identical to SEQ ID NO: 825804

SEQ ID NO: 825806 - protein, 380 aa, Homo sapiens; identical to SEQ ID NO: 825804

SEQ ID NO: 825807 - protein, 336 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAEVGTSQICSSHRFCCSHVFSSKY

SEQ ID NO: 825808 - protein, 437 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYERLESRDKAGPIWWSGLPESLGGLGCRSWAIEGILSLHRVCGEKVKPPFDLQSASPQLCFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 825809 - protein, 220 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRAGSRPRPRGSFPQVGFIP

SEQ ID NO: 825810 - protein, 380 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDSERFWLEVKVTLTEVYGVLLSEMWHGLCLVTMICAPRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 825811 - protein, 140 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESCPEQP

SEQ ID NO: 825812 - protein, 346 aa, Homo sapiens
ARGVAAPSGATMLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRGSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 825813 - protein, 380 aa, Homo sapiens; identical to SEQ ID NO: 825804

SEQ ID NO: 825814 - protein, 380 aa, Homo sapiens; identical to SEQ ID NO: 825804

SEQ ID NO: 825815 - protein, 337 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAEVGTSQICSSHRFCMFSCCSPQNT

SEQ ID NO: 825816 - protein, 437 aa, Homo sapiens; identical to SEQ ID NO: 825808

SEQ ID NO: 825817 - protein, 213 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDSE

SEQ ID NO: 825818 - protein, 260 aa, Homo sapiens
MPDPLFSAVQGKDEILHKALCFCPWLGKGGMEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 825819 - protein, 276 aa, Homo sapiens
MPDPLFSAVQGKDEILHKALCFCPWLGKGGMEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRPSQGSHLPSCLSKEPLSLLEGEIPFPPTSILLLLACIFLIKILAASALWAAAWHGQKPGTHPPSELDCGHDPGYQLQTLPGLRDT

SEQ ID NO: 825820 - protein, 249 aa, Homo sapiens
MPDPLFSAVQGKDEILHKALCFCPWLGKGGMEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHVKEDDGRKSPGEVPPGTSPACILATWPPGLLVLLWQETTLPEHCFSWTLEAGTG

SEQ ID NO: 825821 - protein, 116 aa, Homo sapiens
MDRSQGHIHPVNWTVAMTQGISSKLCQVGLESTAIKGGLGRDGRRCREGPHESLDYCRAERHVKEDDGRKSPGEVPPGTSPACILATWPPGLLVLLWQETTLPEHCFSWTLEAGTG

SEQ ID NO: 825822 - protein, 120 aa, Homo sapiens
WIRTPAIIYSVHTMTTLIPILSTFLFEDFSKASGFKGQRPETSLLQVRQDLPSPSDFYSTPLQPGGQSGFLPSGAPAQQMLLPMVDSQLPVVNFGSLPPAPPPDVDTRAYFTSATIIIAS

SEQ ID NO: 825823 - protein, 2212 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLWNHNCPQKRVLNHQKRFLLLPHPQFQRWNPRVMGLVPPASPLVRAWATPNIRSRCLLVSSGSSSEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825824 - protein, 2296 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEVSEGGRVCLSWDFFEHWSYPPPALGESGAVLSLGCPLSAVCMCASVRYWGAFYPDLTSSFSSSSQMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825825 - protein, 2216 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825826 - protein, 2272 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQVYCIFTLPLHLISLSIAGFDFPWFSDIPPCPQHAHPNFLLQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825827 - protein, 1695 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWRLLTPECCSL

SEQ ID NO: 825828 - protein, 2303 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQVGPASHCMTPSVNNNFFLPGMFYNQAFLRCRVVRYHFVTSFFSLLFASMGGMVIFFLDHRYYSCFNRAPLLQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825829 - protein, 2195 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQVKEKPLWPQL

SEQ ID NO: 825830 - protein, 2155 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGR

SEQ ID NO: 825831 - protein, 2028 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPNLPGPSPLAWGEQSCIQWN

SEQ ID NO: 825832 - protein, 1966 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPHRRCPASQCIKDLN

SEQ ID NO: 825833 - protein, 2072 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYSITAFYPAALLACSRELSGVWSPMRYELGVAVGVSTPLLSLRFARLACLVFGRRSASPRIYLLSRWGKGSPRAPAAMSPGDSVLGTWSCADTLPLLFCTVAVWPRCGATVCIGVLTAASVWGGV

SEQ ID NO: 825834 - protein, 301 aa, Homo sapiens
CSLLREGLGPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825835 - protein, 1777 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRHPLQLCASRSTHAQLFH

SEQ ID NO: 825836 - protein, 175 aa, Homo sapiens [sequence omitted]

SEQ ID NO: 825837 - protein, 896 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMR

SEQ ID NO: 825838 - protein, 765 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQVKSSCLPSKGCFSSWLRSLILFISYLLGPFASLSSCLHC

SEQ ID NO: 825839 - protein, 305 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPR

SEQ ID NO: 825840 - protein, 175 aa, Homo sapiens [sequence omitted]

SEQ ID NO: 825841 - protein, 2231 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825842 - protein, 1470 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSSAWTKLSTATLLASNRLWPSLVAVKGV

SEQ ID NO: 825843 - protein, 851 aa, Homo sapiens
RAQCYQSSVYSSLAALYYIQSSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825844 - protein, 2128 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAEVRYRN

SEQ ID NO: 825845 - protein, 766 aa, Homo sapiens
MERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825846 - protein, 2237 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRRPSSLRSFSGLNSRLKATPSTYSGVFRTQRVDLYQQASPPDALRWIPKPWERTGPPPREGPSRRAEEPGSRGDKEPGLPPPR

SEQ ID NO: 825847 - protein, 2128 aa, Homo sapiens; identical to SEQ ID NO: 825844

SEQ ID NO: 825848 - protein, 1812 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLMPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825849 - protein, 1353 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPALRSREWRPGPPTTTQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTVSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825850 - protein, 285 aa, Homo sapiens
CALLDHRGPQLQRSQGCLSVSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 825851 - protein, 1711 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSISTTLRFEQR

SEQ ID NO: 825852 - protein, 688 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTGACI

SEQ ID NO: 825853 - protein, 691 aa, Homo sapiens
EPARFELQVLRCELLTQGRAANSGAELLTQARAAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPRRAIQVWVCGWGQGKLIGGGDGFLARRLSLDQSRMWLYNMPYFIFFFVYSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPGMEMGIGTTRCQITASRCLKVQGGKAGDK

SEQ ID NO: 825854 - protein, 69 aa, Homo sapiens
VPRERSDSGGSSSEPFDRHAPAMLRERGTPPVDPKLAWVGDVFTATPAEPRPLTSPLRQAADEDDKGMR

SEQ ID NO: 825855 - protein, 151 aa, Homo sapiens
MSKNTVSSARFRKVDVDEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 825856 - protein, 151 aa, Homo sapiens; identical to SEQ ID NO: 825855

SEQ ID NO: 825857 - protein, 151 aa, Homo sapiens; identical to SEQ ID NO: 825855

SEQ ID NO: 825858 - protein, 151 aa, Homo sapiens; identical to SEQ ID NO: 825855

SEQ ID NO: 825859 - protein, 151 aa, Homo sapiens; identical to SEQ ID NO: 825855

SEQ ID NO: 825860 - protein, 151 aa, Homo sapiens; identical to SEQ ID NO: 825855

SEQ ID NO: 825861 - protein, 139 aa, Homo sapiens
GPREQALGSVEVVGVTSASPAPVPASRCPSRSCLRQGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 825862 - protein, 151 aa, Homo sapiens; identical to SEQ ID NO: 825855

SEQ ID NO: 825863 - protein, 151 aa, Homo sapiens; identical to SEQ ID NO: 825855

SEQ ID NO: 825864 - protein, 151 aa, Homo sapiens; identical to SEQ ID NO: 825855

SEQ ID NO: 825865 - protein, 146 aa, Homo sapiens
MHLSDQLNLTFHEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 825866 - protein, 106 aa, Homo sapiens
VAARGRVGGGRGDRDRSLLPTQHGGRGDRAGSIVLKVLISFKANDIEKAVQSLDKNGVDLLMKYIYKGFESPSDNSSAMLLQWHEKALAAGGVGSIVRVLTARKTV

SEQ ID NO: 825867 - protein, 217 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYRSSSLPRCCLHEGLHNGF

SEQ ID NO: 825868 - protein, 245 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 825869 - protein, 217 aa, Homo sapiens; identical to SEQ ID NO: 825867

SEQ ID NO: 825870 - protein, 245 aa, Homo sapiens; identical to SEQ ID NO: 825868

SEQ ID NO: 825871 - protein, 200 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYR

SEQ ID NO: 825872 - protein, 241 aa, Homo sapiens
GFRQVGGEGDAEADKMAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825873 - protein, 241 aa, Homo sapiens; identical to SEQ ID NO: 825872

SEQ ID NO: 825874 - protein, 241 aa, Homo sapiens; identical to SEQ ID NO: 825872

SEQ ID NO: 825875 - protein, 241 aa, Homo sapiens; identical to SEQ ID NO: 825872

SEQ ID NO: 825876 - protein, 123 aa, Homo sapiens
MHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825877 - protein, 137 aa, Homo sapiens
MILPKSIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825878 - protein, 157 aa, Homo sapiens
MAAAAVQGGRSGGSGGCSGAGGASNCGTGSGRSGLLDKWKIDDKPVKIDKWDGSAVKNSLDDSAKKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825879 - protein, 137 aa, Homo sapiens
MQKLSSGRVLGVFEDYQGLKRLLWLEGPGRVRIAGGEVRVQRALGLGEVLTPVIPALDAEADKMAAAAVQGGRSGGSGGCSGAGGASNCGTGSGRSGLLDKWKIDDKPVKIDKWDGSAVKNSLDDSAKKERSYRNGS

SEQ ID NO: 825880 - protein, 272 aa, Homo sapiens
MAAAAVQGGRSGGSGGCSGAGGASNCGTGSGRSGLLDKLCKHRIDSSLVQTWTSARMDQARAQRLFGMISAKNRKLLGTQYQIMVRAHYRIVELEWLAVDTSWYEVSVVVVLHTRWTYASWAYELVRLAYMRRSAPKARSLAFCSVHKSYMLMDDRGDILTRLYDAFISIGTKELVCSTMDPSTRNDSLPVNGSPWMTMLVRLCPPDLYKRFDDKYTLKLTFISGRTKQQREAEFTKSIAKFFDHSGTLVMDAYEPEISRLHDSLAIERKIK

SEQ ID NO: 825881 - protein, 278 aa, Homo sapiens
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAETNEIAMATPVRQIRKLIRDGLIIRKPCDGPFRARLPEKHLGPRKGRPWARYGRYSMADARGPCGDRGFGVKTGLKKVLLRRGS

SEQ ID NO: 825882 - protein, 226 aa, Homo sapiens
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825883 - protein, 241 aa, Homo sapiens; identical to SEQ ID NO: 825872

SEQ ID NO: 825884 - protein, 257 aa, Homo sapiens
MAAAAVQGGRSGGSGGCSGAGGASNCGTGSGRSGLLDKRQALTILPRLDSSSWAQAVLPPQPPKYLGWQWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825885 - protein, 303 aa, Homo sapiens
TAVERLRDPRGARRRASLLTGTSPPQTPRRLKRRRRQAKDTGQWFRKVTSMKKPKGLVGAQAERRESLKATSFEFKGKKESRRENQVDLPGHILDQAFLLKHHCVRKPSDLCTINWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825886 - protein, 127 aa, Homo sapiens
TIQLGPTPPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825887 - protein, 241 aa, Homo sapiens; identical to SEQ ID NO: 825872

SEQ ID NO: 825888 - protein, 241 aa, Homo sapiens; identical to SEQ ID NO: 825872

SEQ ID NO: 825889 - protein, 223 aa, Homo sapiens
MTQRRTRWRRQLYRAGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 825890 - protein, 189 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKSWLPGMLF

SEQ ID NO: 825891 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 825892 - protein, 471 aa, Homo sapiens; identical to SEQ ID NO: 825891

SEQ ID NO: 825893 - protein, 471 aa, Homo sapiens; identical to SEQ ID NO: 825891

SEQ ID NO: 825894 - protein, 471 aa, Homo sapiens; identical to SEQ ID NO: 825891

SEQ ID NO: 825895 - protein, 471 aa, Homo sapiens; identical to SEQ ID NO: 825891

SEQ ID NO: 825896 - protein, 471 aa, Homo sapiens; identical to SEQ ID NO: 825891

SEQ ID NO: 825897 - protein, 471 aa, Homo sapiens; identical to SEQ ID NO: 825891

SEQ ID NO: 825898 - protein, 471 aa, Homo sapiens; identical to SEQ ID NO: 825891

SEQ ID NO: 825899 - protein, 430 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 825900 - protein, 430 aa, Homo sapiens; identical to SEQ ID NO: 825899

SEQ ID NO: 825901 - protein, 471 aa, Homo sapiens; identical to SEQ ID NO: 825891

SEQ ID NO: 825902 - protein, 411 aa, Homo sapiens
MLVSLKMSYKAAAGEDYKADCPPGNPAPTSNHGPDATEAEEDFVDPWTVQTSSAKGIDYDKLIVRFEVVQFLPQGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 825903 - protein, 471 aa, Homo sapiens; identical to SEQ ID NO: 825891

SEQ ID NO: 825904 - protein, 217 aa, Homo sapiens
QHHVFFLHVIGLRGYCENDGVGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 825905 - protein, 386 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKKSCSLPLAHQCSPAK

SEQ ID NO: 825906 - protein, 455 aa, Homo sapiens [sequence omitted]

SEQ ID NO: 825907 - protein, 533 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTREPGHGSSRSTHKVLEAWSGSPGLGMRSRGIGQEMIPEGPRIQDARYYAVQSVVEGKSGTKNSHVGLAWIWRLSGCRNDAGTTISNRYGDRGEMATQRGAGRRNKSERGRRR

SEQ ID NO: 825908 - protein, 409 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKGEQWPRQRAASGIRNMPWGAHAHTHHCTVLWASATQPP

SEQ ID NO: 825909 - protein, 274 aa, Homo sapiens [sequence omitted]

SEQ ID NO: 825910 - protein, 232 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKSKAKSQGSPWLMYLGLLWSTLPSCHPVE

SEQ ID NO: 825911 - protein, 34 aa, Homo sapiens
MCQRLCVVLHLVPSTVMLAGFSMPIPQMRKPKGK

SEQ ID NO: 825912 - protein, 181 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTK

SEQ ID NO: 825913 - protein, 471 aa, Homo sapiens; identical to SEQ ID NO: 825891

SEQ ID NO: 825914 - protein, 471 aa, Homo sapiens; identical to SEQ ID NO: 825891

SEQ ID NO: 825915 - protein, 471 aa, Homo sapiens; identical to SEQ ID NO: 825891

SEQ ID NO: 825916 - protein, 471 aa, Homo sapiens; identical to SEQ ID NO: 825891

SEQ ID NO: 825917 - protein, 430 aa, Homo sapiens; identical to SEQ ID NO: 825899

SEQ ID NO: 825918 - protein, 471 aa, Homo sapiens; identical to SEQ ID NO: 825891

SEQ ID NO: 825919 - protein, 229 aa, Homo sapiens
MSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 825920 - protein, 471 aa, Homo sapiens; identical to SEQ ID NO: 825891

SEQ ID NO: 825921 - protein, 277 aa, Homo sapiens [sequence omitted]

SEQ ID NO: 825922 - protein, 471 aa, Homo sapiens; identical to SEQ ID NO: 825891

SEQ ID NO: 825923 - protein, 471 aa, Homo sapiens; identical to SEQ ID NO: 825891

SEQ ID NO: 825924 - protein, 455 aa, Homo sapiens [sequence omitted]

SEQ ID NO: 825925 - protein, 381 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDMQALKEVFKEYLIELFILQHFQGNIMDFLAFKKKHYAPLQAYLRQNDLDIEEQEEEEEEEEEKSEVI

SEQ ID NO: 825926 - protein, 247 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYTVEVSTEQCPGCVPGRVDLAREKVEAAALEALTDV

SEQ ID NO: 825927 - protein, 390 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFEVVQFLPQGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKGEQWPRQRAASGIRNMPWGAHAHTHHCTVLWASATQPP

SEQ ID NO: 825928 - protein, 415 aa, Homo sapiens
AGSGAGARVPGFPPRLCAAAGSGSRADMGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 825929 - protein, 221 aa, Homo sapiens
AGSGAGARVPGFPPRLCAAAGSGSRADMGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRRENHSCVTLLFPR

SEQ ID NO: 825930 - protein, 415 aa, Homo sapiens; identical to SEQ ID NO: 825928

SEQ ID NO: 825931 - protein, 415 aa, Homo sapiens; identical to SEQ ID NO: 825928

SEQ ID NO: 825932 - protein, 415 aa, Homo sapiens; identical to SEQ ID NO: 825928

SEQ ID NO: 825933 - protein, 221 aa, Homo sapiens; identical to SEQ ID NO: 825929

SEQ ID NO: 825934 - protein, 280 aa, Homo sapiens
MEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 825935 - protein, 415 aa, Homo sapiens; identical to SEQ ID NO: 825928

SEQ ID NO: 825936 - protein, 415 aa, Homo sapiens; identical to SEQ ID NO: 825928

SEQ ID NO: 825937 - protein, 415 aa, Homo sapiens; identical to SEQ ID NO: 825928

SEQ ID NO: 825938 - protein, 444 aa, Homo sapiens
AGSGAGARVPGFPPRLCAAAGSGSRADMGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKDVWAKWECSRKGMKGGARMVPLPTACFTGSPTSLLPGPTIPLQFLPSFKPQLRGLLRSLSRFSSTPGAHVSLLGPSWPYIISSLGHFLDCM

SEQ ID NO: 825939 - protein, 111 aa, Homo sapiens
MVCEKCEKKLGTVITPDTWKDGARNTTESGGRKLNENKALTSKKARFDPYGKNKFSTCRICKSSVHQPGSHYCQGCAYKKGICAMCGNKGFGYQKLQANICLDVLMEFLAF

SEQ ID NO: 825940 - protein, 111 aa, Homo sapiens; identical to SEQ ID NO: 825939

SEQ ID NO: 825941 - protein, 118 aa, Homo sapiens
MCVAITIVKIARLCVTVVSIPDTLQRWLLGTSTAQSGGRKLNENKALTSKKARFDPYGKNKFSTCRICKSSVHQPGSHYCQGCAYKKGICAMCGNKGFGYQKLQANICLDVLMEFLAF

SEQ ID NO: 825942 - protein, 111 aa, Homo sapiens; identical to SEQ ID NO: 825939

SEQ ID NO: 825943 - protein, 662 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 825944 - protein, 662 aa, Homo sapiens; identical to SEQ ID NO: 825943

SEQ ID NO: 825945 - protein, 83 aa, Homo sapiens
MAYEHHYKGSSRGRSKSSRFSGGFGARDYRQSSGASSSSFSSSRASSSRSGGGGHGSSRGFGGGSTTSYWSRIIVQIAAQSTT

SEQ ID NO: 825946 - protein, 662 aa, Homo sapiens; identical to SEQ ID NO: 825943

SEQ ID NO: 825947 - protein, 573 aa, Homo sapiens
MLVLFRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 825948 - protein, 662 aa, Homo sapiens; identical to SEQ ID NO: 825943

SEQ ID NO: 825949 - protein, 657 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGSSRSQEEMKGTISSPVQKVV

SEQ ID NO: 825950 - protein, 639 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLDSRFSGGFGARDYRQSSGASSSSFSSSRASSSRSGGGGHGSSRGFGGGSSRSQEEMKGTISSPVQKVV

SEQ ID NO: 825951 - protein, 459 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQLVANFKRKFFLVFEKWPTLETSTQGFWGKSTTGILLPLKAGRVLPLVWGPKGSILGSFPEGPGAHLGTF

SEQ ID NO: 825952 - protein, 662 aa, Homo sapiens; identical to SEQ ID NO: 825943

SEQ ID NO: 825953 - protein, 662 aa, Homo sapiens; identical to SEQ ID NO: 825943

SEQ ID NO: 825954 - protein, 662 aa, Homo sapiens; identical to SEQ ID NO: 825943

SEQ ID NO: 825955 - protein, 662 aa, Homo sapiens; identical to SEQ ID NO: 825943

SEQ ID NO: 825956 - protein, 169 aa, Homo sapiens
GRAQPGKQLEDGYMAHVTDVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 825957 - protein, 662 aa, Homo sapiens; identical to SEQ ID NO: 825943

SEQ ID NO: 825958 - protein, 457 aa, Homo sapiens
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 825959 - protein, 457 aa, Homo sapiens; identical to SEQ ID NO: 825958

SEQ ID NO: 825960 - protein, 366 aa, Homo sapiens
MEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 825961 - protein, 366 aa, Homo sapiens; identical to SEQ ID NO: 825960

SEQ ID NO: 825962 - protein, 457 aa, Homo sapiens; identical to SEQ ID NO: 825958

SEQ ID NO: 825963 - protein, 406 aa, Homo sapiens
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYSIPGNSQIAIEQMCGFLKIIYIYELPIFAIQNFVNMQISFIGLLQVF

SEQ ID NO: 825964 - protein, 86 aa, Homo sapiens
FEIPSPVLSRMFALQAGRFTSFVRCHRCEKPYKCTWEGCDWRFARSDELTRHYRKHTGAKPFQCGVCNRSFSRSDHLALHMKRHQN

SEQ ID NO: 825965 - protein, 457 aa, Homo sapiens; identical to SEQ ID NO: 825958

SEQ ID NO: 825966 - protein, 457 aa, Homo sapiens; identical to SEQ ID NO: 825958

SEQ ID NO: 825967 - protein, 366 aa, Homo sapiens; identical to SEQ ID NO: 825960

SEQ ID NO: 825968 - protein, 281 aa, Homo sapiens
GELQEGLGRGRRRGSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 825969 - protein, 477 aa, Homo sapiens
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTVVKLSVPDYFASICKRKVCEGEKPYKCTWEGCDWRFARSDELTRHYRKHTGAKPFQCGVCNRSFSRSDHLALHMKRHQN

SEQ ID NO: 825970 - protein, 66 aa, Homo sapiens
NRRSNPDLEKRRIHYCDYPGMCSYLVEASIDVVCVCVCLCARACACVHARALFNLMALNRKVVLDS

SEQ ID NO: 825971 - protein, 2994 aa, Homo sapiens
ARWDLQKHSLLIVIGDIGTESQLRAVRAHLEQGILSWNIDLSSFDLNQQLRLFITRHLAHFSSEVKGQRTLCHQSEILETIILVNPSADSISSEVHHLLSSSSAYKLLILSGQSLEPGGDLILQSGTYSYENFAQVLHNPEISQLLSNRDPGIQAFLTVSCLGEGDWSHLGLSSSQETLHLRLNPEPTLPTMDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLVLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 825972 - protein, 2796 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPGWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLVLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 825973 - protein, 2006 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGVRGMGANPQLLQAGI

SEQ ID NO: 825974 - protein, 1383 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPDPFSSPAWLLCMWSSAVAWCLMG

SEQ ID NO: 825975 - protein, 2803 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLVLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 825976 - protein, 2803 aa, Homo sapiens; identical to SEQ ID NO: 825975

SEQ ID NO: 825977 - protein, 1854 aa, Homo sapiens
MSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLVLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 825978 - protein, 92 aa, Homo sapiens
TFARRAYRAFWRCRERGEEEGGYEAVADRGVETYPNDAGERGFGRRWRRRRDSSGRKKRPLPAVRAAKGPNPSHSPSLKERKPTRRPARLPQ

SEQ ID NO: 825979 - protein, 132 aa, Homo sapiens
MVGRNSAIAAGVCGALFIGYCIYFDRKRRSDPNFKNRLREGRKKQKLAKERAGLSKLPDLKDAEAVQKFFLEEIQLGEELLAQGEYEKGVDHLTNGIAVCGQPQQLLQALQQTLPPLVFQMLLTKLPTIREF

SEQ ID NO: 825980 - protein, 92 aa, Homo sapiens; identical to SEQ ID NO: 825978

SEQ ID NO: 825981 - protein, 92 aa, Homo sapiens; identical to SEQ ID NO: 825978

SEQ ID NO: 825982 - protein, 92 aa, Homo sapiens; identical to SEQ ID NO: 825978

SEQ ID NO: 825983 - protein, 114 aa, Homo sapiens
MVGRNSAIAAGVCGALFIGYCIYFDRQKLAKERAGLSKLPDLKDAEAVQKFFLEEIQLGEELLAQGEYEKGVDHLTNGIAVCGQPQQLLQALQQTLPPLVFQMLLTKLPTIREF

SEQ ID NO: 825984 - protein, 589 aa, Homo sapiens
SEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 825985 - protein, 286 aa, Homo sapiens
MHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 825986 - protein, 215 aa, Homo sapiens
MHVMKDLLPETTYRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 825987 - protein, 377 aa, Homo sapiens
SEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDKCIQDQEHTHRV

SEQ ID NO: 825988 - protein, 260 aa, Homo sapiens
AAVSRGSDAISSLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 825989 - protein, 589 aa, Homo sapiens; identical to SEQ ID NO: 825984

SEQ ID NO: 825990 - protein, 365 aa, Homo sapiens
EPPAEPLQYLACYRFHCSHQLGDNMWFLTTLLLWGGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGGQALEAPTQGCA

SEQ ID NO: 825991 - protein, 395 aa, Homo sapiens
EPPAEPLQYLACYRFHCSHQLGDNMWFLTTLLLWGGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 825992 - protein, 395 aa, Homo sapiens; identical to SEQ ID NO: 825991

SEQ ID NO: 825993 - protein, 307 aa, Homo sapiens
GATSRTSSISCMLQISLLPPAWRQHVVLDNSAPLGGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 825994 - protein, 78 aa, Homo sapiens
SEYSRGSPREPLPYLMLCLASLYIMMTLTSWYSPDAKFQSMTSKWPAVWVKISSSWVCLLLYVWTLVAPLVLTSRDFS

SEQ ID NO: 825995 - protein, 473 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 825996 - protein, 473 aa, Homo sapiens; identical to SEQ ID NO: 825995

SEQ ID NO: 825997 - protein, 473 aa, Homo sapiens; identical to SEQ ID NO: 825995

SEQ ID NO: 825998 - protein, 473 aa, Homo sapiens; identical to SEQ ID NO: 825995

SEQ ID NO: 825999 - protein, 344 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTVWTTRKRECSIATPYSTSCSAWLPCTS

SEQ ID NO: 826000 - protein, 473 aa, Homo sapiens; identical to SEQ ID NO: 825995

SEQ ID NO: 826001 - protein, 455 aa, Homo sapiens
MGAVLGVFSLASWVPCLCSGASCLLCSCCPNSKNSTVTRLIYAFILLLSTVVSYIMQRKEMETYLKKIPGFCEGGFYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 826002 - protein, 427 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 826003 - protein, 473 aa, Homo sapiens; identical to SEQ ID NO: 825995

SEQ ID NO: 826004 - protein, 364 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPEPLTEVAAFGSILVYLALIPPVLAVLTAERIAAFPGVSQFGAAAYGHGQEEATVATWKTSLTLRSEDREEHST

SEQ ID NO: 826005 - protein, 307 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEQQPPPTHFFSTNLFFQQKNPSLLREPSDFLHLKSVKSSCFLLPYP

SEQ ID NO: 826006 - protein, 247 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWLVVDDRGSLFILIQMVCGNSVIWDAMVIDEKNQVECAMLKAYTDTVGQFNTREKLNRLGYPMTRCHNCVVFLAFSPKDTPKHRPHDG

SEQ ID NO: 826007 - protein, 138 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFNI

SEQ ID NO: 826008 - protein, 80 aa, Homo sapiens
IRASVEGCVSGLRNRHVSGESPQLAVTTVLESSLRTGHLHHWRHHGGCAGCLLPRQLENPGELKARHGGSRQDGLNLLTS

SEQ ID NO: 826009 - protein, 239 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALRCHKRLLSGTMGGGIITHHGGEQLQVRLRGYVQ

SEQ ID NO: 826010 - protein, 473 aa, Homo sapiens; identical to SEQ ID NO: 825995

SEQ ID NO: 826011 - protein, 473 aa, Homo sapiens; identical to SEQ ID NO: 825995

SEQ ID NO: 826012 - protein, 473 aa, Homo sapiens; identical to SEQ ID NO: 825995

SEQ ID NO: 826013 - protein, 473 aa, Homo sapiens; identical to SEQ ID NO: 825995

SEQ ID NO: 826014 - protein, 418 aa, Homo sapiens
MQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 826015 - protein, 473 aa, Homo sapiens; identical to SEQ ID NO: 825995

SEQ ID NO: 826016 - protein, 292 aa, Homo sapiens
LALTGMPYLTGFYSKDLIIEAANTLLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 826017 - protein, 473 aa, Homo sapiens; identical to SEQ ID NO: 825995

SEQ ID NO: 826018 - protein, 233 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGQVWMLLLSSSAYICWSAAFINTDVRTSSNNDWGVIA

SEQ ID NO: 826019 - protein, 194 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSGPFNAGVEWPFNASGPFNASGPFKRLRAIQAPPGTY

SEQ ID NO: 826020 - protein, 149 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFGSFLALWFGGRMIGAA

SEQ ID NO: 826021 - protein, 110 aa, Homo sapiens
MEGRVGIDKKGIGDMWSLALDENSMFDVTGWPFTSRRDEVAMYGDAYSLIDLASTESTTYLPRTYHMDCSRSCPQTLPQCSHDRLHSFLVWWMPSNISEEYFSQVSCCLF

SEQ ID NO: 826022 - protein, 829 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 826023 - protein, 449 aa, Homo sapiens
MARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 826024 - protein, 312 aa, Homo sapiens
GLLMLLTNLLTCSKCLSFLWLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 826025 - protein, 188 aa, Homo sapiens
HWVICLFCLYRLFFETGPVTVDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 826026 - protein, 115 aa, Homo sapiens [sequence omitted]

SEQ ID NO: 826027 - protein, 829 aa, Homo sapiens; identical to SEQ ID NO: 826022

SEQ ID NO: 826028 - protein, 637 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKVSCCLPATFNGQEQWGESSASASTKIHSMTAHVCSLAQEGQGHTRNQAGGHISFGKLMC

SEQ ID NO: 826029 - protein, 593 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDVARCYGIL

SEQ ID NO: 826030 - protein, 390 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHFSMARAIRGGSS

SEQ ID NO: 826031 - protein, 88 aa, Homo sapiens
MGCAPSIHISERLVAEDAPSPAAPPLSSGGPRLPQGQKTAALPRTRGAGLLESELRDGSGKKVRGAGHSGAAAKLGPGQYSNFPASRA

SEQ ID NO: 826032 - protein, 657 aa, Homo sapiens
MPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 826033 - protein, 181 aa, Homo sapiens
MERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 826034 - protein, 123 aa, Homo sapiens [sequence omitted]

SEQ ID NO: 826035 - protein, 123 aa, Homo sapiens
NLLQPPSNAITVKWRLGHCSLGLLQELFRKAHEDHGLPQFLVKHKVWSAPAKGIDGFLPVFDRNTCSIPKSQISFIDYFITDMFDAWDAFVDLPDLMQHLDNNFKYWKGLDEMKLRNLRPPPE

SEQ ID NO: 826036 - protein, 757 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQVSCCLF

SEQ ID NO: 826037 - protein, 314 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGG

SEQ ID NO: 826038 - protein, 324 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSRYKSAGLPMQSGSLPTWAWPAGRAAFCFFKFLLVLAVEPCLGFRAELLARAFDRQTIHIHMPGPWAFPTVQCDENHRTHASRIGRVWRREAPGCIPRRPSSESLPPRAVRSGAVLLLLPSESICRDFSQGWASLFWAVRSTPMSRAPGMQFHVDVTKPQCGGRDSHGNVGDEAQAGNGLESHWSSNS

SEQ ID NO: 826039 - protein, 318 aa, Homo sapiens
MAQQRALPQSKETLLQSYNKRLKDDIKSIMDNFTEIIKTAKIEDETQVSRATQGEQDNYEMHVRAGESLMKLVSDLKQFLILNDFPSVNEAIDQRNQQLRTLQEECDRKLITLRDEISIDLYELEEEYYSSRYKYAGLPMQSGSLPTWAWPAGRAAFCFFKFLLVLAVEPCLGFRAELLARAFDRQTIHIHMPGPWAFPTVQCDENHRTHASRIGRVWRREAPGCIPRRPSSESLPPRAVRSGAVLLLLPSESICRDFSQGWASLFWAVRSTPMSRAPGMQFHVDVTKPQCGGRDSHGNVGDEAQAGNGLESHWSSNS

SEQ ID NO: 826040 - protein, 262 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSRYKSAGLPMQSGSLPTWAWPAGRAAFCFFKFLLVLAVEPCLGFRAELLARAFDRQTIHIHMPGPWAFPTVQCDENHRTHASRIGRVWRREAPGCIPRRPSSESLPPRAVRSGAVLLLLPLKPSTV

SEQ ID NO: 826041 - protein, 200 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSSSSLCEANDLPLCEAYGRLDLDTDSADGLSAPLLASPEPSAGPLQVAAPAHSHAGGPGPTEHA

SEQ ID NO: 826042 - protein, 200 aa, Homo sapiens; identical to SEQ ID NO: 826041

SEQ ID NO: 826043 - protein, 150 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSSWQNSRLRNCRAP

SEQ ID NO: 826044 - protein, 131 aa, Homo sapiens
MLGWLSPLAASPCQACQLRGQMEQEWRKGKAGLGCGRVFLTLLLSCSPLPWLSSLPAPVSPWGFWWWKSSSLCEANDLPLCEAYGRLDLDTDSADGLSAPLLASPEPSAGPLQVAAPAHSHAGGPGPTEHA

SEQ ID NO: 826045 - protein, 236 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 826046 - protein, 201 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLCHLVENTDDLVELIM

SEQ ID NO: 826047 - protein, 236 aa, Homo sapiens; identical to SEQ ID NO: 826045

SEQ ID NO: 826048 - protein, 242 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTNSSDTWQ

SEQ ID NO: 826049 - protein, 181 aa, Homo sapiens
MTTRSLLNVLREFWQAQMSGSPHTILLVKLPKKLLRKFNNEINMNEKVKRHQRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 826050 - protein, 192 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNGKNKSGIDQICR

SEQ ID NO: 826051 - protein, 119 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRTRSLGWFRIRF

SEQ ID NO: 826052 - protein, 236 aa, Homo sapiens; identical to SEQ ID NO: 826045

SEQ ID NO: 826053 - protein, 217 aa, Homo sapiens [sequence omitted]

SEQ ID NO: 826054 - protein, 236 aa, Homo sapiens; identical to SEQ ID NO: 826045

SEQ ID NO: 826055 - protein, 257 aa, Homo sapiens
MSGSPHTILLVKLPKKLLRKFNNEINMNEKVKRHQSIGEPKSLHVTESWSLVSAKTPSKATKDATCCDTIITSPYSRRSLDEQSDKHKSLERTQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 826056 - protein, 125 aa, Homo sapiens
MSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 826057 - protein, 197 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKG

SEQ ID NO: 826058 - protein, 104 aa, Homo sapiens
MVHLTPEEKSAVTALWGKVNVDEVGGEALGRLLVVYPWTQRFLESFGDLSTPDAVMGNPKVKAHGKKVLGAFSDGLAHLDNLKGTFATLSELHCDKLHVDPENF

SEQ ID NO: 826059 - protein, 104 aa, Homo sapiens; identical to SEQ ID NO: 826058

SEQ ID NO: 826060 - protein, 104 aa, Homo sapiens; identical to SEQ ID NO: 826058

SEQ ID NO: 826061 - protein, 80 aa, Homo sapiens
PPGNSRTMVHLTPEEKSAVTALWGKAVNVDEVGGEALGRLLVVYPWTQRFFESFGDLSTPDAVMGNPKVKAHGKKVLRCL

SEQ ID NO: 826062 - protein, 133 aa, Homo sapiens
FFCKKALFAGEQEFNQKGQIPCHHLTLQTPPSSHLSSPLLQQGQNQQQGLQSLGQQRRLTMVHLTPEEKSAVTALWGKAVNVDEVGGEALGRLLVVYPWTQRFFESFGDLSTPDAVMGNPKVKAHGKKVLRCL

SEQ ID NO: 826063 - protein, 117 aa, Homo sapiens
MVHLTPEEKSAVTALWGKAVNVDEVGGEALGRGWYQGYKTGLRRPIETGHVETEKTLGFLIGTDSLCLLVYFPTLRLLVVYPWTQRFFESFGDLSTPDAVMGNPKVKAHGKKVLRCL

SEQ ID NO: 826064 - protein, 118 aa, Homo sapiens
RGNSEHDPPYWRGAVWLNVNYLALGALHHYGHLEGPHQARAAKLHLELRANVVGNVWRQYQATGFSLGAVGGEALGRLLVVYPWTQRFFESFGDLSTPDAVMGNPKVKAHGKKVLRCL

SEQ ID NO: 826065 - protein, 104 aa, Homo sapiens; identical to SEQ ID NO: 826058

SEQ ID NO: 826066 - protein, 104 aa, Homo sapiens; identical to SEQ ID NO: 826058

SEQ ID NO: 826067 - protein, 383 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 826068 - protein, 67 aa, Homo sapiens
VVSYPLVALGGIGDQESVKSEVQYLKDRQLAGAMVWALDLDDFQGSFCGQDLRFPLTNAIKDALAAT

SEQ ID NO: 826069 - protein, 305 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEVMELGRR

SEQ ID NO: 826070 - protein, 415 aa, Homo sapiens [sequence omitted]

SEQ ID NO: 826071 - protein, 305 aa, Homo sapiens; identical to SEQ ID NO: 826069

SEQ ID NO: 826072 - protein, 383 aa, Homo sapiens; identical to SEQ ID NO: 826067

SEQ ID NO: 826073 - protein, 383 aa, Homo sapiens; identical to SEQ ID NO: 826067

SEQ ID NO: 826074 - protein, 364 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRFSKIASNTQSRRTFIKSVPPFLRTHGFDGLDLAWLYPGRGDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 826075 - protein, 322 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTICDFLRGATVHRILGQQVPYATKGNQWVGYDDQESVKSKVQYLKDRQLAGAMVWALDLDDFQGSFCGQDLRFPLTNAIKDALAAT

SEQ ID NO: 826076 - protein, 269 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRADFGPRFSKIASNTQSRRTFIKSVPPFLRTHGFDGLDLAWLYPGRGDKQHFTTLIKEMKAEFIKEAQPGKKQLLLSAALSAGKVTIDSSYDIAKISQHLDFISIMTYDFHGAWRGTTGHHSPLFRGQEDASPDRFSNTVSSQKEGGPGGGRKTCHLPVLTHQSL

SEQ ID NO: 826077 - protein, 383 aa, Homo sapiens; identical to SEQ ID NO: 826067

SEQ ID NO: 826078 - protein, 383 aa, Homo sapiens; identical to SEQ ID NO: 826067

SEQ ID NO: 826079 - protein, 383 aa, Homo sapiens; identical to SEQ ID NO: 826067

SEQ ID NO: 826080 - protein, 383 aa, Homo sapiens; identical to SEQ ID NO: 826067

SEQ ID NO: 826081 - protein, 112 aa, Homo sapiens
ERDPQKRCHSAVKCKGFYKLASGEVRCYLTYIGCEKPQVCNLRRALISGIPPPHPFIIQAGLLPELLHVAFLLCMCFKGGGGASMVDTPGPRYPFLSVQLQAYCKAQLETFT

SEQ ID NO: 826082 - protein, 430 aa, Homo sapiens
MECTRSCAARGPCRKVAGTSETLCGRLGRGHILSLFCCSHIGCESGRLETMSLCWSLVAAYLVGVGSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRGDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 826083 - protein, 263 aa, Homo sapiens [sequence omitted]

SEQ ID NO: 826084 - protein, 326 aa, Homo sapiens
TRGRPTRPIDTWEWNDVTLYGMLNTLKNRNPNLKTLLSVGGWNFGSQRFSKIASNTQSRRTFIKSVPPFLRTHGFDGLDLAWLYPGRGDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 826085 - protein, 263 aa, Homo sapiens [sequence omitted]

SEQ ID NO: 826086 - protein, 180 aa, Homo sapiens [sequence omitted]

SEQ ID NO: 826087 - protein, 383 aa, Homo sapiens; identical to SEQ ID NO: 826067

SEQ ID NO: 826088 - protein, 119 aa, Homo sapiens [sequence omitted]

SEQ ID NO: 826089 - protein, 355 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKMPRPPLAPAGREPDHLPC

SEQ ID NO: 826090 - protein, 549 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826091 - protein, 465 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPSSRAT

SEQ ID NO: 826092 - protein, 549 aa, Homo sapiens; identical to SEQ ID NO: 826090

SEQ ID NO: 826093 - protein, 435 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYRWMGQPGARGGASLGPAEWKSQRDHEAPKLRSSRPP

SEQ ID NO: 826094 - protein, 435 aa, Homo sapiens; identical to SEQ ID NO: 826093

SEQ ID NO: 826095 - protein, 476 aa, Homo sapiens [sequence omitted]

SEQ ID NO: 826096 - protein, 435 aa, Homo sapiens; identical to SEQ ID NO: 826093

SEQ ID NO: 826097 - protein, 476 aa, Homo sapiens [sequence omitted]

SEQ ID NO: 826098 - protein, 465 aa, Homo sapiens; identical to SEQ ID NO: 826091

SEQ ID NO: 826099 - protein, 515 aa, Homo sapiens
MLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826100 - protein, 522 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLREARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826101 - protein, 400 aa, Homo sapiens [sequence omitted]

SEQ ID NO: 826102 - protein, 553 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFVDFHQYYHGFFCYACCLDFGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826103 - protein, 310 aa, Homo sapiens
MVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826104 - protein, 273 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQPSLSSPTVPAASTVTRT

SEQ ID NO: 826105 - protein, 253 aa, Homo sapiens
MPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826106 - protein, 406 aa, Homo sapiens
MIRTAAQLCYQAAFYLSPSGFPSDGPLVCALEQERRLRLPPKPPPPLQPLLREARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTQPGWLAGPLRAGEAGEQGGLQAQSPSPRLPTGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826107 - protein, 414 aa, Homo sapiens
MRRPRGEPGPRAPRPTEGATCAGPGESCFPSDGPLVCALEQERRLRLPPKPPPPLQPLLREARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTQPGWLAGPLRAGEAGEQGGLQAQSPSPRLPTGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826108 - protein, 159 aa, Homo sapiens
MLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGGTEVGPALWATELPAPGTAVYALP

SEQ ID NO: 826109 - protein, 99 aa, Homo sapiens
RKRERRKVENSPSNPMIRTAAQLCYQAAFYLSPSGFPSDGPLVCALEQERRLRLPPKPPPPLQPLLRGGQGLEAALSCPRFLRYPRQHLISSLAGAGGG

SEQ ID NO: 826110 - protein, 582 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTQPGWLAGPLRAGEAGEQGGLQAQSPSPRLPTGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826111 - protein, 549 aa, Homo sapiens; identical to SEQ ID NO: 826090

SEQ ID NO: 826112 - protein, 490 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTGEQGAGGRPGETEPWLRPPALLPSRLPAVRQQLWCCASREDPGPLPAIPTKVLPTGPGCL

SEQ ID NO: 826113 - protein, 531 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPVSGPGLARGASSLPACG

SEQ ID NO: 826114 - protein, 490 aa, Homo sapiens; identical to SEQ ID NO: 826112

SEQ ID NO: 826115 - protein, 494 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQSYPSRNWSPREACPSSRAT

SEQ ID NO: 826116 - protein, 462 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTATLRGTGVPERPAPAQELPEAEAPGPGPALGA

SEQ ID NO: 826117 - protein, 515 aa, Homo sapiens; identical to SEQ ID NO: 826099

SEQ ID NO: 826118 - protein, 310 aa, Homo sapiens; identical to SEQ ID NO: 826103

SEQ ID NO: 826119 - protein, 408 aa, Homo sapiens
MRRPRGEPGPRAPRPTEGATCAGPGESCFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 826120 - protein, 239 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHPSLSSPTVPAASTVTRT

SEQ ID NO: 826121 - protein, 253 aa, Homo sapiens; identical to SEQ ID NO: 826105

SEQ ID NO: 826122 - protein, 246 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLREARPEELTPHVMVLLAQHLARHRLREPQPSLSSPTVPAASTVTRT

SEQ ID NO: 826123 - protein, 159 aa, Homo sapiens; identical to SEQ ID NO: 826108

SEQ ID NO: 826124 - protein, 1251 aa, Homo sapiens
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 826125 - protein, 866 aa, Homo sapiens
MINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 826126 - protein, 623 aa, Homo sapiens
MTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQILPGRGCPGTCPVPQ

SEQ ID NO: 826127 - protein, 337 aa, Homo sapiens [sequence omitted]

SEQ ID NO: 826128 - protein, 610 aa, Homo sapiens
MINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDADRKHTGDQQAFIQQF

SEQ ID NO: 826129 - protein, 185 aa, Homo sapiens
MLTEALTLPEILMHSFNNFELLIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 826130 - protein, 789 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 826131 - protein, 789 aa, Homo sapiens; identical to SEQ ID NO: 826130

SEQ ID NO: 826132 - protein, 685 aa, Homo sapiens [sequence omitted]

SEQ ID NO: 826133 - protein, 774 aa, Homo sapiens
MAATTANPEMTSDVPSLGPAIASGNSGPGIQGGGAIVQRAIKRRPGLDFDDDGEGNSKFLRCDDDQMSNDKERFARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 826134 - protein, 278 aa, Homo sapiens
MVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 826135 - protein, 288 aa, Homo sapiens
QSQDPRCTPAAPCQQPGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 826136 - protein, 547 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTATASQLITSEFAA

SEQ ID NO: 826137 - protein, 321 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAVRK

SEQ ID NO: 826138 - protein, 113 aa, Homo sapiens
MTAYITELSDMVPTCSALARKPDKLTILRMAVSHMKSLRGTGNTSTDGSYKPSFLTDQVSGTYSSERVWNLGESLESFRFLDKNSAFQEEVRQWENEFQSLAITLISHWDNEK

SEQ ID NO: 826139 - protein, 789 aa, Homo sapiens; identical to SEQ ID NO: 826130

SEQ ID NO: 826140 - protein, 323 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGFPPR

SEQ ID NO: 826141 - protein, 866 aa, Homo sapiens
GAGMLGAAEAAILDSAVAEAAVRRRFWGVAFLFPSLPVRWRRLLPLGGGWRGGGGICGHGGDYCQPRLILDSRFSCLRPRVAGTTEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 826142 - protein, 169 aa, Homo sapiens
TKLGRAWVSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 826143 - protein, 789 aa, Homo sapiens; identical to SEQ ID NO: 826130

SEQ ID NO: 826144 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 826145 - protein, 265 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKERGGTTLSGG

SEQ ID NO: 826146 - protein, 470 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSAPRFKQFSCFSLPSSWDYRRTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 826147 - protein, 455 aa, Homo sapiens; identical to SEQ ID NO: 826144

SEQ ID NO: 826148 - protein, 455 aa, Homo sapiens; identical to SEQ ID NO: 826144

SEQ ID NO: 826149 - protein, 455 aa, Homo sapiens; identical to SEQ ID NO: 826144

SEQ ID NO: 826150 - protein, 455 aa, Homo sapiens; identical to SEQ ID NO: 826144

SEQ ID NO: 826151 - protein, 455 aa, Homo sapiens; identical to SEQ ID NO: 826144

SEQ ID NO: 826152 - protein, 228 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLFHSA

SEQ ID NO: 826153 - protein, 228 aa, Homo sapiens; identical to SEQ ID NO: 826152

SEQ ID NO: 826154 - protein, 455 aa, Homo sapiens; identical to SEQ ID NO: 826144

SEQ ID NO: 826155 - protein, 455 aa, Homo sapiens; identical to SEQ ID NO: 826144

SEQ ID NO: 826156 - protein, 455 aa, Homo sapiens; identical to SEQ ID NO: 826144

SEQ ID NO: 826157 - protein, 495 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQDSSNSPASASQVAGITGCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 826158 - protein, 455 aa, Homo sapiens; identical to SEQ ID NO: 826144

SEQ ID NO: 826159 - protein, 455 aa, Homo sapiens; identical to SEQ ID NO: 826144

SEQ ID NO: 826160 - protein, 347 aa, Homo sapiens
MGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 826161 - protein, 223 aa, Homo sapiens
MYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 826162 - protein, 254 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIGEWGLWEG

SEQ ID NO: 826163 - protein, 218 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPK

SEQ ID NO: 826164 - protein, 108 aa, Homo sapiens
MRGRARGVVFPRTPGGLPRPVLCTSSPTKGETEAPRGVGRAGWTSGPAAGAVVRPLCRGGPLGFRVSSGKRLAGLVGCAAILETDDSSPLDGFAGSAPASAPIFPAAP

SEQ ID NO: 826165 - protein, 108 aa, Homo sapiens; identical to SEQ ID NO: 826164

SEQ ID NO: 826166 - protein, 108 aa, Homo sapiens; identical to SEQ ID NO: 826164

SEQ ID NO: 826167 - protein, 108 aa, Homo sapiens; identical to SEQ ID NO: 826164

SEQ ID NO: 826168 - protein, 108 aa, Homo sapiens; identical to SEQ ID NO: 826164

SEQ ID NO: 826169 - protein, 72 aa, Homo sapiens
CPGPRPHARTHTAPHTAPPHPATSPVDCLIHPPPRWPADLVPCSHPRAGGADAALWVPEGPGGSDDPPPSLH

SEQ ID NO: 826170 - protein, 103 aa, Homo sapiens
MYSPYCLTQDEFHPFIEALLPHVRAFSYTWFNLQARKRKYFKKHEKRMSKDEERAVKDELLGEKPEIKQKQPARLFPLRPAPPRPRHCASVIPSLPDSLRLLH

SEQ ID NO: 826171 - protein, 470 aa, Homo sapiens
GFIRGCLHHVALLSALIPSSPPPVLPRPACTPRTASPRDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826172 - protein, 470 aa, Homo sapiens; identical to SEQ ID NO: 826171

SEQ ID NO: 826173 - protein, 470 aa, Homo sapiens; identical to SEQ ID NO: 826171

SEQ ID NO: 826174 - protein, 470 aa, Homo sapiens; identical to SEQ ID NO: 826171

SEQ ID NO: 826175 - protein, 470 aa, Homo sapiens; identical to SEQ ID NO: 826171

SEQ ID NO: 826176 - protein, 502 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 826177 - protein, 400 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGSPRATASALHFPSTSIIQQSSPYFTHPTIRYHHHHGQDSLKEFVQFVCSDGSGQATGQHSQRQAPPLPTGLSASDPGTATF

SEQ ID NO: 826178 - protein, 449 aa, Homo sapiens
MEMSWARQSLAGIPAACDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826179 - protein, 440 aa, Homo sapiens
FQVSKCQHDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826180 - protein, 374 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGEKWGAPEGGSWGGG

SEQ ID NO: 826181 - protein, 278 aa, Homo sapiens
LCSSCHLSRAGVDLKASSPKSLPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826182 - protein, 265 aa, Homo sapiens
NVGVSNVGVTNVGVSNVGVSQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826183 - protein, 141 aa, Homo sapiens
AVLEDPRDRYRCGPHDVSSPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826184 - protein, 116 aa, Homo sapiens
PPCCVLSNPDQKGKIRRIDCLRQADKVWRLDLVMVILFKGIPLESTDGERLYKSPQCSNPGLCVQPHHIGVTIKELDLYLAYFVHTPGRSFSTIFPSHFIFLAGICSVYCSSNFQA

SEQ ID NO: 826185 - protein, 153 aa, Homo sapiens
MLSTASSQPGTGPLSPLSAGQEGLLPATREGSRAPGRPRPQPCMQVPSLRPISSCPCPSCRLPCWGRAGGWSRKGTPEPSEEDQAAAAAALSHHLRLGRRPARRLSVPWEGVGCRPFQKCFGAFCAPRLSPAPRPRHCASVIPSLPDSLRLLH

SEQ ID NO: 826186 - protein, 470 aa, Homo sapiens; identical to SEQ ID NO: 826171

SEQ ID NO: 826187 - protein, 470 aa, Homo sapiens; identical to SEQ ID NO: 826171

SEQ ID NO: 826188 - protein, 441 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826189 - protein, 451 aa, Homo sapiens
LSPESQNRALGFAGCFRSMDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 826190 - protein, 441 aa, Homo sapiens; identical to SEQ ID NO: 826188

SEQ ID NO: 826191 - protein, 400 aa, Homo sapiens; identical to SEQ ID NO: 826177

SEQ ID NO: 826192 - protein, 159 aa, Homo sapiens
DDGTAMGAELESGDRGPRGQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKNPDNQIVQTSKEMRTSNHCPTGT

SEQ ID NO: 826193 - protein, 144 aa, Homo sapiens [sequence omitted]

SEQ ID NO: 826194 - protein, 204 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPGRSFSTIFPSHFIFLSMY

SEQ ID NO: 826195 - protein, 519 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPSRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 826196 - protein, 519 aa, Homo sapiens; identical to SEQ ID NO: 826195

SEQ ID NO: 826197 - protein, 334 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSIGRELSTPVTFPDGRSLPKGIMVLLSIYGLHHNPKVWPNPEVFDPSRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 826198 - protein, 417 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGMKFPHPLTQ

SEQ ID NO: 826199 - protein, 214 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLVSPCLSPLPTPTHSTHSHQLHSQPCVPQADIDIDSWNNTLRSLL

SEQ ID NO: 826200 - protein, 154 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIAPDCLPIHLSPSSCLLVCSYISFLLLL

SEQ ID NO: 826201 - protein, 519 aa, Homo sapiens; identical to SEQ ID NO: 826195

SEQ ID NO: 826202 - protein, 579 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPSRFAPGSAQHSHAFLPFSGGSRNCIGKQFAMNELKVATALTLLRFELLPDPTRIPIPIARLVLKSRPALRASTCRPVFLTPASVPFLSAHILFSVCPPSLLPTCLLSPSLPALLSLTFLQAPYLLVYLSPTHLYLLLGEKLSVGRS

SEQ ID NO: 826203 - protein, 455 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPSRFAPGSAQHSHAFLPFSGGSR

SEQ ID NO: 826204 - protein, 214 aa, Homo sapiens; identical to SEQ ID NO: 826199

SEQ ID NO: 826205 - protein, 200 aa, Homo sapiens
MEKPYNKNEGNLENEGKPEDEVEPDDEGKSDEEEKPDVEGKTECEGKREDEGEPGDEGQLEDEGSQEKQGRSEGEGKPQGEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQRGLHDIPYL

SEQ ID NO: 826206 - protein, 200 aa, Homo sapiens; identical to SEQ ID NO: 826205

SEQ ID NO: 826207 - protein, 120 aa, Homo sapiens
FVFGKEKHALAEMKQKPLLGKRDPHQRPCLLRSWEHLFWFPEPAPELQRSSEDTQHHPAVRQNGTYILILRLFNMVPVTSKATQEAASSIFPKGLSSGSSPCWPSWGCHWGSGSRTSQEW

SEQ ID NO: 826208 - protein, 120 aa, Homo sapiens; identical to SEQ ID NO: 826207

SEQ ID NO: 826209 - protein, 120 aa, Homo sapiens; identical to SEQ ID NO: 826207

SEQ ID NO: 826210 - protein, 120 aa, Homo sapiens; identical to SEQ ID NO: 826207

SEQ ID NO: 826211 - protein, 120 aa, Homo sapiens; identical to SEQ ID NO: 826207

SEQ ID NO: 826212 - protein, 120 aa, Homo sapiens; identical to SEQ ID NO: 826207

SEQ ID NO: 826213 - protein, 120 aa, Homo sapiens; identical to SEQ ID NO: 826207

SEQ ID NO: 826214 - protein, 206 aa, Homo sapiens
MESHSLLWPEGGARGQSHLDVTLASARIQTTKNIWNWDVCFEAARKQVKGNQDNSLSLRWQGSKIPCAGKPEPRGATAQLKMTGHQPCTIRNQHLSSPLRRAPGVSLYPSQTSGLQQMWLHAIRIILPCGLGLASFEIESTSPFLFVMKTPAPAPLGCYLTPVQRKGGKLRRKGRDRQDSISQLVRIRALPTIFSYQKSTEFPRGR

SEQ ID NO: 826215 - protein, 120 aa, Homo sapiens; identical to SEQ ID NO: 826207

SEQ ID NO: 826216 - protein, 120 aa, Homo sapiens; identical to SEQ ID NO: 826207

SEQ ID NO: 826217 - protein, 711 aa, Homo sapiens [sequence omitted]

SEQ ID NO: 826218 - protein, 711 aa, Homo sapiens [sequence omitted]

SEQ ID NO: 826219 - protein, 711 aa, Homo sapiens [sequence omitted]

SEQ ID NO: 826220 - protein, 666 aa, Homo sapiens
MRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826221 - protein, 650 aa, Homo sapiens
ASLGLFYFQENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826222 - protein, 621 aa, Homo sapiens
LEDPFDCHVEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826223 - protein, 711 aa, Homo sapiens [sequence omitted]

SEQ ID NO: 826224 - protein, 711 aa, Homo sapiens [sequence omitted]

SEQ ID NO: 826225 - protein, 457 aa, Homo sapiens
DSSSVPDLPFCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826226 - protein, 711 aa, Homo sapiens [sequence omitted]

SEQ ID NO: 826227 - protein, 705 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLILPVNSGLCFA

SEQ ID NO: 826228 - protein, 241 aa, Homo sapiens
ASTRWELSYCRPAGGANSLVISHVGRANQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826229 - protein, 577 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGR

SEQ ID NO: 826230 - protein, 590 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAQMQSRHGLQ

SEQ ID NO: 826231 - protein, 526 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCAS

SEQ ID NO: 826232 - protein, 580 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFGKEFQRCGGWATLEGRHIVLWNLREGRGGDLQADSGLQASSSIRKFSLWLPPGGVGALGVSLHSTSHAPFTPPQD

SEQ ID NO: 826233 - protein, 154 aa, Homo sapiens
AVQLDLSIYRIPVTVLTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826234 - protein, 411 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKEKLMP

SEQ ID NO: 826235 - protein, 355 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSE

SEQ ID NO: 826236 - protein, 102 aa, Homo sapiens [sequence omitted]

SEQ ID NO: 826237 - protein, 169 aa, Homo sapiens [sequence omitted]

SEQ ID NO: 826238 - protein, 99 aa, Homo sapiens
MRKVRGPPVSCIKRDSPIQCIQAIAVSQCRVLVGTKLNGREREMEKDRTRALLTSSAIGSILWPRVGIRRTTEHSFSYGQPDTVLGEVDAAANLVVVGG

SEQ ID NO: 826239 - protein, 711 aa, Homo sapiens [sequence omitted]

SEQ ID NO: 826240 - protein, 107 aa, Homo sapiens
MGSGTWALIIWLLCHLCGFHAQGHLMAHIASLSPVPASAFYVQDEEREGEERAKGMYQLSFKDVSEKLAPNTPADISLAYSYPYGHMSPRESDKSSLYTKGGPRVGG

SEQ ID NO: 826241 - protein, 726 aa, Homo sapiens
MARNLGMPSRLQTADMKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826242 - protein, 710 aa, Homo sapiens
MRPPSSCCSSGPSGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826243 - protein, 711 aa, Homo sapiens [sequence omitted]

SEQ ID NO: 826244 - protein, 504 aa, Homo sapiens
DSSSVPDLPLCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826245 - protein, 711 aa, Homo sapiens [sequence omitted]

SEQ ID NO: 826246 - protein, 300 aa, Homo sapiens
MSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 826247 - protein, 169 aa, Homo sapiens [sequence omitted]

SEQ ID NO: 826248 - protein, 624 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPGCADDDRMIDGPRDTRYAFNER

SEQ ID NO: 826249 - protein, 551 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCAGVLGPWPPLLKVGIAHPSAYNSLLSS

SEQ ID NO: 826250 - protein, 524 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCDEGIPQGPHDR

SEQ ID NO: 826251 - protein, 539 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMLTKVSALLRRLARIGVLDEGKMKLDYILGLKIEGFFKRDACRPRSS

SEQ ID NO: 826252 - protein, 359 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEREGL

SEQ ID NO: 826253 - protein, 245 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFGKSRVMSRGY

SEQ ID NO: 826254 - protein, 245 aa, Homo sapiens; identical to SEQ ID NO: 826253

SEQ ID NO: 826255 - protein, 191 aa, Homo sapiens
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQKQMVAQQESIREGFQKRCLPVMVLKAKKPFTFETQEEKLVKPRRSTRFKLSPLEQL

SEQ ID NO: 826256 - protein, 343 aa, Homo sapiens
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQKQMVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTLQTQPLGTIVNGLFVVQKVTEKKKNILFDLSDNTGKMEVLGVRNEDTMKCKEGDKVRLTFFTLSKNGEKLQLTSGVHSTIKVIKAKKKT

SEQ ID NO: 826257 - protein, 435 aa, Homo sapiens
ACWPGVAGAAEAWAAEKGSCLLCNPENGLQERKNWASAWESIVETQGVSRPVPGRQLEYGLTRYLDGDLSWRRRCAWEEIAEAVNMEKQPQNSRRGLAPREVPPAVGLLLIMALMNTLLYLCLDHFFIAPRQSTVDPTHCPYGHFRIGQMKNCSPWLSCEELRTEVRQLKRVGEGAVKRVFLSEWKEHKVALSQLTSLEMKDDFLHGLQMLKSLQGTHVVTLLGYCEDDNTMLTEYHPLGSLSNLEETLNLSKYQNVNTWQHRLELAMDYVSIINYLHHSPVGTRVMCDSNDLPKTLSQYLLTSNFSILANDLDALPLVNHSSGMLVKCGHRELHGDFVAPEQLWPYGEDVPFHDDLMPSYDEKIDIWKIPDISSFLLGHIEGSDMVRFHLFDIHKACKSQTPSERPTAQDVLETYQKVLDTLRDAMMSQAREML

SEQ ID NO: 826258 - protein, 148 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 826259 - protein, 148 aa, Homo sapiens; identical to SEQ ID NO: 826258

SEQ ID NO: 826260 - protein, 114 aa, Homo sapiens [sequence omitted]

SEQ ID NO: 826261 - protein, 128 aa, Homo sapiens
LHRARTLPFTPWLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 826262 - protein, 148 aa, Homo sapiens; identical to SEQ ID NO: 826258

SEQ ID NO: 826263 - protein, 137 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSGWHGEIVVKTEMSVSMFKVVECNSRIFLLQLILSLSH

SEQ ID NO: 826264 - protein, 148 aa, Homo sapiens; identical to SEQ ID NO: 826258

SEQ ID NO: 826265 - protein, 148 aa, Homo sapiens; identical to SEQ ID NO: 826258

SEQ ID NO: 826266 - protein, 148 aa, Homo sapiens; identical to SEQ ID NO: 826258

SEQ ID NO: 826267 - protein, 104 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSGKTS

SEQ ID NO: 826268 - protein, 148 aa, Homo sapiens; identical to SEQ ID NO: 826258

SEQ ID NO: 826269 - protein, 148 aa, Homo sapiens; identical to SEQ ID NO: 826258

SEQ ID NO: 826270 - protein, 148 aa, Homo sapiens; identical to SEQ ID NO: 826258

SEQ ID NO: 826271 - protein, 148 aa, Homo sapiens; identical to SEQ ID NO: 826258

SEQ ID NO: 826272 - protein, 148 aa, Homo sapiens; identical to SEQ ID NO: 826258

SEQ ID NO: 826273 - protein, 152 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCLSFFSSFCLSHIKGVGIK

SEQ ID NO: 826274 - protein, 148 aa, Homo sapiens; identical to SEQ ID NO: 826258

SEQ ID NO: 826275 - protein, 110 aa, Homo sapiens
MLSVWEAFSQSAHSPQHERIHTEKKPYTCKTCGKAFSQRTSLILHERSHTGEKPYECNECGKAFSSGSDLIRHQRSHSSEKPYECSKCGKAYSRSSSLIRHQNTHSEEKA

SEQ ID NO: 826276 - protein, 145 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRFCWAI

SEQ ID NO: 826277 - protein, 154 aa, Homo sapiens
SKTLPVATEVGLRGLCRVERVLPGPGPSATTMDRRKKPLDVTASSLVDLKAELFRKQEEFKQEKLLKDSGVFGKPKTTNKKPSIWSKQNVGVSNRAEKDAEQKIEEQKTLDKARQCISKALKQGRFPIFLMQILSSIPSLQQFASRQLSWKFRL

SEQ ID NO: 826278 - protein, 498 aa, Homo sapiens
SKTLPVATEVGLRGLCRVERVLPGPGPSATTMDRRKKPLDVTASSLVDLKAELFRKQEEFKQEKLLKDSGVFGKPKTTNKKPSIWSKQNVGVSNRAEKDAEQKIEEQKTLDKAREKLEEKAKLYEKMTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 826279 - protein, 498 aa, Homo sapiens; identical to SEQ ID NO: 826278

SEQ ID NO: 826280 - protein, 342 aa, Homo sapiens
EEDDNIIYVTHKLMKGVKKEFVKHVQIPPPQDPSEEWVDYVDSLGRSRRCMRKDLPDLLEMDKNLQGRLFISPANEKTLLSEDMRKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 826281 - protein, 478 aa, Homo sapiens
SKTLPVATEVGLRGLCRVERVLPGPGPSATTMDRRKKPLDVTASSLVDLKAELFRKQEEFKQEKLLKDSGVFGKPKTTNKKPSIWSKQNVGVSNRAEKDAEQKIEEQKTLDKAREKLEEKAKLYEKMTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGNFPLDTGRRGSQISGLREILSLPRRQITLWVRRELVFPAARHGADLGQHRVTQGSALTRATDLALNIRHPLLPPTTHHKPPQLLSKLWMT

SEQ ID NO: 826282 - protein, 154 aa, Homo sapiens; identical to SEQ ID NO: 826277

SEQ ID NO: 826283 - protein, 215 aa, Homo sapiens
SKTLPVATEVGLRGLCRVERVLPGPGPSATTMDRRKKPLDVTASSLVDLKAELFRKQEEFKQEKLLKDSGVFGKPKTTNKKPSIWSKQNVGVSNRAEKDAEQKIEEQKTLDKAREKKKKKKKKKICGGALGLGKSFLNLWWGGGARGYVCNCGANECSLRETAAHRHNVRGFLHQIKNARGGTGGVVKNSRGGPGGIKGLFQREVQESRLINPDD

SEQ ID NO: 826284 - protein, 422 aa, Homo sapiens
SKTLPVATEVGLRGLCRVERVLPGPGPSATTMDRRKKPLDVTASSLVDLKAELFRKQEEFKQEKLLKDSGVFGKPKTTNKKPSIWSKQNVGVSNRAEKDAEQKIEEQKTLDKAREKLEEKAKLYEKMTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 826285 - protein, 269 aa, Homo sapiens
GRYYYKIRGRVGKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 826286 - protein, 164 aa, Homo sapiens [sequence omitted]

SEQ ID NO: 826287 - protein, 81 aa, Homo sapiens
ATTTKFAAASTGIGELLWGQFISAIPTRSLKFLKEAGHGTTKEEITKDAEGLDEIDHAEMELRRGQILWFRGLNRIQTQVL

SEQ ID NO: 826288 - protein, 1205 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 826289 - protein, 143 aa, Homo sapiens
QSPNSAQSPNSAQSPNSAQSPNSAQSPNSAHSPNSAQSPNSAQSPNSAQSPNSAQSPNSALPLELQRGELAWLNLNGYLTAENPEGRGTLACVEKPLNASLPFFPASFALQLKQPVVPSQYAETSSPFISRDHPRCIGEGGHL

SEQ ID NO: 826290 - protein, 1170 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 826291 - protein, 1241 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 826292 - protein, 1134 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 826293 - protein, 309 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKNLVGNRPVPP

SEQ ID NO: 826294 - protein, 57 aa, Homo sapiens
PPVLLLSPLGEKFFDIDSGRKAPLHSPPSQHYTIVFNTFVLMQLFNEINSRKIHGEK

SEQ ID NO: 826295 - protein, 1205 aa, Homo sapiens; identical to SEQ ID NO: 826288

SEQ ID NO: 826296 - protein, 106 aa, Homo sapiens
MVRAKFRSNLPAKAIGHRIRVMLYPSRIETNEKSINKCGFVLIVFLSGLKNLLPGLGLPGQVDLSTRLCGKASKCIPSFLSCFLCLTIEAARGTITVCRDFLTFHI

SEQ ID NO: 826297 - protein, 1164 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGSE

SEQ ID NO: 826298 - protein, 1130 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQHLLQDSDLLPDKEEAIISSSLFPSCNF

SEQ ID NO: 826299 - protein, 309 aa, Homo sapiens; identical to SEQ ID NO: 826293

SEQ ID NO: 826300 - protein, 76 aa, Homo sapiens
VIIVVLVTAFNDWSKEKQFRGLQCRIEQEQKFSIIRNGQLIQLPVAEIVVGDIAQVKYGESSVFLLLTPPPPPFKG

SEQ ID NO: 826301 - protein, 912 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGLPASAVPPRVWGPGCPQAQ

SEQ ID NO: 826302 - protein, 818 aa, Homo sapiens
MYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGLPASAVPPRVWGPGCPQAQ

SEQ ID NO: 826303 - protein, 538 aa, Homo sapiens
MEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGLPASAVPPRVWGPGCPQAQ

SEQ ID NO: 826304 - protein, 195 aa, Homo sapiens
MREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGLPASAVPPRVWGPGCPQAQ

SEQ ID NO: 826305 - protein, 117 aa, Homo sapiens [sequence omitted]

SEQ ID NO: 826306 - protein, 912 aa, Homo sapiens; identical to SEQ ID NO: 826301

SEQ ID NO: 826307 - protein, 912 aa, Homo sapiens; identical to SEQ ID NO: 826301

SEQ ID NO: 826308 - protein, 827 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLR

SEQ ID NO: 826309 - protein, 418 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDGVKRDLLLTPKCLYLIGREKVKQGPDKGLVKEVLKRKIEIERILSVSLR

SEQ ID NO: 826310 - protein, 912 aa, Homo sapiens; identical to SEQ ID NO: 826301

SEQ ID NO: 826311 - protein, 889 aa, Homo sapiens
MVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGLPASAVPPRVWGPGCPQAQ

SEQ ID NO: 826312 - protein, 912 aa, Homo sapiens; identical to SEQ ID NO: 826301

SEQ ID NO: 826313 - protein, 912 aa, Homo sapiens; identical to SEQ ID NO: 826301

SEQ ID NO: 826314 - protein, 178 aa, Homo sapiens
AQDQIVLSFNANDIIDIIKEDPSGWWTGRLRGKQGLFPNNYVTKIRGARDSDTWGRGAPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYETLKRLGWGQGVSLHK

SEQ ID NO: 826315 - protein, 635 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQR

SEQ ID NO: 826316 - protein, 532 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWKLGIMSHEHCAIGDEMRRIGPLICPCRGRSPNAW

SEQ ID NO: 826317 - protein, 193 aa, Homo sapiens [sequence omitted]

SEQ ID NO: 826318 - protein, 193 aa, Homo sapiens [sequence omitted]

SEQ ID NO: 826319 - protein, 193 aa, Homo sapiens [sequence omitted]

SEQ ID NO: 826320 - protein, 193 aa, Homo sapiens [sequence omitted]

SEQ ID NO: 826321 - protein, 193 aa, Homo sapiens [sequence omitted]

SEQ ID NO: 826322 - protein, 193 aa, Homo sapiens [sequence omitted]

SEQ ID NO: 826323 - protein, 193 aa, Homo sapiens [sequence omitted]

SEQ ID NO: 826324 - protein, 193 aa, Homo sapiens [sequence omitted]

SEQ ID NO: 826325 - protein, 259 aa, Homo sapiens
ELVAVVNEHPHGPVDTLQVLCAVEVLAVFVPGHCMLWPGPRTGDDESMAQSLLVELNGHLGHPGPAAHFGHIVNDGQQPSRMVFVFSQGTKQLRTSTSGVWSLALVRSFLGTALEPQDTIIGHGLEVAWGEVWALQVAEADAPLLPTHSAAVTGGPFPEGGEDMEVPIVFICKGLLALVLESGHHSLTVLDVHIVGVKVVPLAGAAEVQAWVLRLSPENQQAEHADAEAGQHVAAHTYLGCLRQHPPIKVRQHFGVAAT

SEQ ID NO: 826326 - protein, 193 aa, Homo sapiens [sequence omitted]

SEQ ID NO: 826327 - protein, 193 aa, Homo sapiens [sequence omitted]

SEQ ID NO: 826328 - protein, 134 aa, Homo sapiens
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQAIYKMVSS

SEQ ID NO: 826329 - protein, 193 aa, Homo sapiens [sequence omitted]

SEQ ID NO: 826330 - protein, 1500 aa, Homo sapiens
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMTYMMVMDHHFATLHHNQNMSKEEMINLHSSMFLERQILPGLSVMNLLSFLLCVPVQFFGGWYFYIQAYKALKHKTANMDVLIVLATTIAFAYSLIILLVAMYERAKVNPITFFDTPPMLFVFIALGRWLEHIAKGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRKTVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 826331 - protein, 1500 aa, Homo sapiens; identical to SEQ ID NO: 826330

SEQ ID NO: 826332 - protein, 1121 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826333 - protein, 844 aa, Homo sapiens
RLGTGCVVNRPSIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826334 - protein, 640 aa, Homo sapiens
KARYEAAWLIGRGRSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826335 - protein, 595 aa, Homo sapiens
SYVEAIPDVYVHTRACVNKRSTWTTASSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826336 - protein, 1121 aa, Homo sapiens; identical to SEQ ID NO: 826332

SEQ ID NO: 826337 - protein, 1101 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKVGNPEASGDGGHVRESESSQLQE

SEQ ID NO: 826338 - protein, 404 aa, Homo sapiens
SGVSLKPVDSEGGGHVLRRSSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826339 - protein, 293 aa, Homo sapiens
MKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826340 - protein, 1121 aa, Homo sapiens; identical to SEQ ID NO: 826332

SEQ ID NO: 826341 - protein, 1121 aa, Homo sapiens; identical to SEQ ID NO: 826332

SEQ ID NO: 826342 - protein, 1101 aa, Homo sapiens; identical to SEQ ID NO: 826337

SEQ ID NO: 826343 - protein, 206 aa, Homo sapiens
PAPACAAPNACAGSPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826344 - protein, 208 aa, Homo sapiens
VRRSWSKGSPRMLMWLPIDRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826345 - protein, 118 aa, Homo sapiens [sequence omitted]

SEQ ID NO: 826346 - protein, 1064 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRELAEIGQEDLWFRINP

SEQ ID NO: 826347 - protein, 1050 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVSLLDFTLPISHYDYILVKSCSLITDSLPSLFTNCRTGIAG

SEQ ID NO: 826348 - protein, 1115 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGEARDGENYVVLLDSTLPRIQYDYILPQDSFTAVGYHKTFTVIFNPPRNCLTGNAKVQLPQGGADGRVTRKQLGGVEGEDRPAFNRREKANRAQTVGAPNGQPPTCGRAS

SEQ ID NO: 826349 - protein, 1120 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDKPRNRRQGGREEEGDSCSLTWDRPQPGVRLRDGENYVVLLDSTLPRIQYDYILPQDSFTAVGYHKTFTVIFNPPRNCLTGNAKVQLPQGGADGRVTRKQLGGSEGEDRPAFNRREKANRAQTVGAPNGQPPTCGRAS

SEQ ID NO: 826350 - protein, 848 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLVTCSAIYHLPVFPEREPGCSMRGLMCCLTT

SEQ ID NO: 826351 - protein, 822 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAERGEDRPSDAWGRPIQQIQSQAPFVGTSAFRLAGTSFMA

SEQ ID NO: 826352 - protein, 559 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTFHLVSVN

SEQ ID NO: 826353 - protein, 102 aa, Homo sapiens [sequence omitted]

SEQ ID NO: 826354 - protein, 313 aa, Homo sapiens
SIICEDGSNRNSFIMGLKKYWPGFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826355 - protein, 718 aa, Homo sapiens
QDCRVTSKSPQVSKQETFQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826356 - protein, 621 aa, Homo sapiens
VFTKYLDIGVERLLKPVAGARGHFVHTRLGQAESVDSFGEVINPHILTPSDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826357 - protein, 1121 aa, Homo sapiens; identical to SEQ ID NO: 826332

SEQ ID NO: 826358 - protein, 1107 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKGHIRPGERPAHPWGLISKRPASFELKPTH

SEQ ID NO: 826359 - protein, 1121 aa, Homo sapiens; identical to SEQ ID NO: 826332

SEQ ID NO: 826360 - protein, 1121 aa, Homo sapiens; identical to SEQ ID NO: 826332

SEQ ID NO: 826361 - protein, 221 aa, Homo sapiens
TDSRVFLQPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826362 - protein, 1166 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 826363 - protein, 1105 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLLSEAAWPSARTPCSRLVNCSSKGWAG

SEQ ID NO: 826364 - protein, 118 aa, Homo sapiens [sequence omitted]

SEQ ID NO: 826365 - protein, 118 aa, Homo sapiens
LFSISSVVTWISIKQGLLIFPHKACLDFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 826366 - protein, 1009 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVFPLHLRSCWKPRQPVSTIRR

SEQ ID NO: 826367 - protein, 955 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEPVVGQPVVGQPVVGQPVVG

SEQ ID NO: 826368 - protein, 1017 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLQPWSALSFRPPCPPGSPGLPTPLPRQPAPPAAQHSASTPAHTPPPPAHRNPPPPTPPAPHRPPPPPRTPPHPPAPAHAPTPPPPHRTRHRPPTRQHTPPARTTHPQAARQASNHYTRAPPALAPRDRLRPPTDPTPPNATHTPTHHPPQAADAPPPSPNPQHPTATDAPCPHHQNPRAQPHHPPPRGHTHPHPPPHPRA

SEQ ID NO: 826369 - protein, 379 aa, Homo sapiens
PTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVRCIVLNLKCFEKKQ

SEQ ID NO: 826370 - protein, 321 aa, Homo sapiens
PLSARPAPSAGGAAPRSHPGRELGASGQPRAAQRSPQKPGQRTCPRDLQTCATGSARPRGARTPRSPHPSRQSPAMGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 826371 - protein, 321 aa, Homo sapiens; identical to SEQ ID NO: 826370

SEQ ID NO: 826372 - protein, 321 aa, Homo sapiens; identical to SEQ ID NO: 826370

SEQ ID NO: 826373 - protein, 265 aa, Homo sapiens
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 826374 - protein, 344 aa, Homo sapiens
PLSARPAPSAGGAAPRSHPGRELGASGQPRAAQRSPQKPGQRTCPRDLQTCATGSARPRGARTPRSPHPSRQSPAMGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 826375 - protein, 305 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 826376 - protein, 284 aa, Homo sapiens
RPSEGPAPPPLRWRLLGHLCDEAGTLEVGGARRRCPERPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 826377 - protein, 321 aa, Homo sapiens; identical to SEQ ID NO: 826370

SEQ ID NO: 826378 - protein, 201 aa, Homo sapiens
PLSARPAPSAGGAAPRSHPGRELGASGQPRAAQRSPQKPGQRTCPRDLQTCATGSARPRGARTPRSPHPSRQSPAMGCFECCIKCLGGVPYASLVATILCFSGVALFCGCGHVALAGTVAILEQQYGQLVKSSSHRRPTGPRVWSRSVWISDNTVSFLGMLSPEKYVALPWRTSATQTSSTCPITCSLWPVQELVPPSLPC

SEQ ID NO: 826379 - protein, 382 aa, Homo sapiens
PLSARPAPSAGGAAPRSHPGRELGASGQPRAAQRSPQKPGQRTCPRDLQTCATGSARPRGARTPRSPHPSRQSPAMGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLIDTWTSKLGLNLQGCEAKMQGLPPIFKPRDRTRKLPGYSQSRVKENHSPHVYTINVMARDVRTTQLTSLTKSSTSEPGYHGVP

SEQ ID NO: 826380 - protein, 326 aa, Homo sapiens
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLIDTWTSKLGLNLQGCEAKMQGLPPIFKPRDRTRKLPGYSQSRVKENHSPHVYTINVMARDVRTTQLTSLTKSSTSEPGYHGVP

SEQ ID NO: 826381 - protein, 265 aa, Homo sapiens
RPSEGPAPPPLRWRLLGHLCDEAGTLEVGGARRRCPERPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALVSNGPKT

SEQ ID NO: 826382 - protein, 321 aa, Homo sapiens; identical to SEQ ID NO: 826370

SEQ ID NO: 826383 - protein, 265 aa, Homo sapiens; identical to SEQ ID NO: 826373

SEQ ID NO: 826384 - protein, 265 aa, Homo sapiens; identical to SEQ ID NO: 826373

SEQ ID NO: 826385 - protein, 361 aa, Homo sapiens
PLSARPAPSAGGAAPRSHPGRELGASGQPRAAQRSPQKPGQRTCPRDLQTCATGSARPRGARTPRSPHPSRQSPAMVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 826386 - protein, 182 aa, Homo sapiens
MLTLLFQIHFLMITVFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 826387 - protein, 307 aa, Homo sapiens
RPSEGPAPPPLRWRLLGHLCDEAGTLEVGGARRRCPERPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 826388 - protein, 103 aa, Homo sapiens
MFNRRKDNMILKAFTPAAMSPKIIIIVKLKSYLPMANRKKLSIGSSHHNPHFLHCLLDHSFLVPNSARGELVSSFFFFFKLREALFCVEQLFQNSLVFCFPVA

SEQ ID NO: 826389 - protein, 282 aa, Homo sapiens
SGGKLKARYEAGFATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGPTDDGEEEMEEDTVTNGS

SEQ ID NO: 826390 - protein, 286 aa, Homo sapiens
AAWRRGAGHAGTSRWREATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGPTDDGEEEMEEDTVTNGS

SEQ ID NO: 826391 - protein, 286 aa, Homo sapiens; identical to SEQ ID NO: 826390

SEQ ID NO: 826392 - protein, 206 aa, Homo sapiens
AAWRRGAGHAGTSRWREATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKVSSNLLLVSHYRVVCFSLYFCY

SEQ ID NO: 826393 - protein, 185 aa, Homo sapiens
AAWRRGAGHAGTSRWREATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKF

SEQ ID NO: 826394 - protein, 94 aa, Homo sapiens
CCLAAGRGARWDVSLAGGHGLSTARGNGRLQDGQADGGADRAGGAVHQRGARPGAGPPGILRNPVTNKKHYRLYVIYKVPQVRVLDFQKVKLKF

SEQ ID NO: 826395 - protein, 206 aa, Homo sapiens; identical to SEQ ID NO: 826392

SEQ ID NO: 826396 - protein, 231 aa, Homo sapiens
AAWRRGAGHAGTSRWREATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKCHSKCFNSG

SEQ ID NO: 826397 - protein, 73 aa, Homo sapiens
LVFWVADTWLKLIIHLHCPLSSRNAIANASTLAEVERLKGLLQSGQIPGRERRSGPTDDGEEEMEEDTVTNGS

SEQ ID NO: 826398 - protein, 286 aa, Homo sapiens; identical to SEQ ID NO: 826390

SEQ ID NO: 826399 - protein, 286 aa, Homo sapiens; identical to SEQ ID NO: 826390

SEQ ID NO: 826400 - protein, 230 aa, Homo sapiens
MLGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGPTDDGEEEMEEDTVTNGS

SEQ ID NO: 826401 - protein, 66 aa, Homo sapiens
SGGKLKAKVRGRVGHGLSTARGNGRLQDGQADGGADRAGGAVHQRGARPGAGPPGVIWTLWHLSNR

SEQ ID NO: 826402 - protein, 203 aa, Homo sapiens
AAWRRGAGHAGTSRWREATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKVSSNLLLVSHRAWPKTVFI

SEQ ID NO: 826403 - protein, 163 aa, Homo sapiens
AAWRRGAGHAGTSRWREATGFPQRGGTGGCRMVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELVSCTEGKCIWWVGLKVLCASYRKFTKSRK

SEQ ID NO: 826404 - protein, 1220 aa, Homo sapiens
IPAPVSGRPPPGLLAEGKLSGPRPMCRTRLGSHTAASAPARMWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPQYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 826405 - protein, 187 aa, Homo sapiens
SSRPCACAPRQGRGRDGTENWRLGLFSASRSWLSFQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 826406 - protein, 123 aa, Homo sapiens
SSRPCACAPRQGRGRDGTENWRLGLFSASRSWLSFQASTVCTWSQERACAYSSVQITVVFLKDEKYHSLPIIIKGSVGGLLVLIVILVILFKCGFFKRKYQQLNLESIRKAQLKSENLLEEEN

SEQ ID NO: 826407 - protein, 155 aa, Homo sapiens
SSRPCACAPRQGRGRDGTENWRLGLFSASRSWLSFQASTVCTWSQERACAYSSVQLLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 826408 - protein, 155 aa, Homo sapiens; identical to SEQ ID NO: 826407

SEQ ID NO: 826409 - protein, 1129 aa, Homo sapiens
IPAPVSGRPPPGLLAEGKLSGPRPMCRTRLGSHTAASAPARMWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPQYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKAHVSVVWQLEENAFPNRTADITVTVTKPSIMYVNTGQGLSHHKEFLFHVHGENLFGAEYQLQICVPTKLRGLQVAAVKKLTRTQASTVCTWSQERACAYSSVQLLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 826410 - protein, 167 aa, Homo sapiens
MPLHQISAIPSQDAISARVYRSKTKEKEREEQNEKTLGHFMSHSSNISKAGSPPSASAPAPVSSFSRTSITPSSQDICSSSAVFSECCHHSSVQSAVVSKAPHCQSSLTQGLTVTVICKDTLQASKRNSFGSEWAQALKPAKNTKARRTLKFSRSLNDVGEKAQDTS

SEQ ID NO: 826411 - protein, 167 aa, Homo sapiens; identical to SEQ ID NO: 826410

SEQ ID NO: 826412 - protein, 289 aa, Homo sapiens [sequence omitted]

SEQ ID NO: 826413 - protein, 276 aa, Homo sapiens
MPLHQISAIPSQDAISARVYRSKTKEKEREEQNEKTLGHFMSHSSNISKAGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWILFMYVQCKVYVQLWKRLKAYNRVIYVQNCPETSKKNIFEKSPLTEPNFENKHGYGICHSDTNSSCCTEPEDTGAEIIHV

SEQ ID NO: 826414 - protein, 289 aa, Homo sapiens [sequence omitted]

SEQ ID NO: 826415 - protein, 289 aa, Homo sapiens [sequence omitted]

SEQ ID NO: 826416 - protein, 212 aa, Homo sapiens
MRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 826417 - protein, 67 aa, Homo sapiens
PRRGSATPGSGSLCPGARVCPWGRAERNQESQKRSAPRALGRPPRVPGEFLSLTGCETLARQPSSLA

SEQ ID NO: 826418 - protein, 186 aa, Homo sapiens
PLGVLPRRGVGCKQATRWGRCGLAASTSRACSRRARAVAPPAQSPPEVTPAASRIGVPHAARSRRRWPPIRAAEPPARAGGVAAGSASATGGLGWAGLGWAGWGRPPRTHPCAAGPAWSPRRGSATPGSGSLCPGARVCPWGRAERNQESQKRSAPRALGRPPRVPGEFLSLTGCETLARQPSSLA

SEQ ID NO: 826419 - protein, 212 aa, Homo sapiens; identical to SEQ ID NO: 826416

SEQ ID NO: 826420 - protein, 289 aa, Homo sapiens [sequence omitted]

SEQ ID NO: 826421 - protein, 289 aa, Homo sapiens [sequence omitted]

SEQ ID NO: 826422 - protein, 145 aa, Homo sapiens [sequence omitted]

SEQ ID NO: 826423 - protein, 155 aa, Homo sapiens
RRKLQPGSLRGRFRPTLTWRRPLSALECRPRPSRGRDAPPSAVGSGTWQVMSRTRGAKLEFTQANCQKRVAWAVWKSELDANSLAQHVRIHTAQALVMFQTDADFYQQYGPGGTWPAGQVLQAGELVFRPRDGAEGQPALAETSPTAPECPPPAE

SEQ ID NO: 826424 - protein, 241 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGESDAKDPAGCPVTSQQPGHRVVRAALGQVARAPAPLEPVLPRMTYCVFQGVCFNQSRHNSLG

SEQ ID NO: 826425 - protein, 810 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTGPATLPAVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826426 - protein, 810 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGCPVPSPGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826427 - protein, 459 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQGT

SEQ ID NO: 826428 - protein, 740 aa, Homo sapiens
MDFPQHSQHVLEQLNQQRQLGLLCDCTFVVDGVHFKAHKAVLAACSEYFKMLFVDQKDVVHLDISNAAGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826429 - protein, 516 aa, Homo sapiens
TADGAAPTARVQAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826430 - protein, 247 aa, Homo sapiens
HASPFLWPHRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826431 - protein, 92 aa, Homo sapiens
RRKLQPGSLRGRFRPTLTWRRPLSALECRPRPSRGRDAPPSAVGSGTWQVMSRTRGAKLEFTQANCQKRVAWAVWKSEPWTFPSTASMSWNS

SEQ ID NO: 826432 - protein, 122 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKWPAGQVLQAGELVFRPRDGAEGQPALAETSPTAPECPPPAE

SEQ ID NO: 826433 - protein, 120 aa, Homo sapiens
RAGPGEVSDPWAEGSNPASGASPTQVQSRQRKPMRPGSRRLWSSSQTPRVAWLLQKLRPLCPRARSKVAPPSQDQALPGASSQGPASTAHWGLPLLLPPASPTWSHHALQLWDTLVFACS

SEQ ID NO: 826434 - protein, 803 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826435 - protein, 803 aa, Homo sapiens; identical to SEQ ID NO: 826434

SEQ ID NO: 826436 - protein, 938 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVCGPLPEPAPGSRRWPQPHACHVVGRAGSTAPASRSSSACSPRKQAQREPLPRGSSRLLCGGQADSGRGLVLKKWGGAAYLSPLGPGTSPDPGEIEPFTDPGKPESQLFLCEEGQVRGPGAELCGVAPLTPPWAQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826437 - protein, 834 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGRARAALAALTPLLLGHRWCPTPGSPSVIATGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826438 - protein, 727 aa, Homo sapiens
MYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 826439 - protein, 240 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQVACRAGAAGWGAGLPPSRRG

SEQ ID NO: 826440 - protein, 274 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGESDAKDPAGCPVTSQQPGHRVVRAALGQVARAPAPLEPVLPRMTYCVFQGVCFNQSTGHVPDRRGLLSAVWARWHVACRAGAAGWGAGLPPSRRG

SEQ ID NO: 826441 - protein, 118 aa, Homo sapiens
MLLLYLEEKPRQGYNEDNSERRSTVRWNFWIARRMRLSMGALLARTLRMRRKLQPGSLRGRFRPTLTWRRPLSALECRPRPSRGRDAPPSAVGSGTWQVSVNNRPGPGKSREPGRRRR

SEQ ID NO: 826442 - protein, 204 aa, Homo sapiens
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQDLQSEDG

SEQ ID NO: 826443 - protein, 177 aa, Homo sapiens
ELNCFLLCFHNRFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQDLQSEDG

SEQ ID NO: 826444 - protein, 204 aa, Homo sapiens; identical to SEQ ID NO: 826442

SEQ ID NO: 826445 - protein, 204 aa, Homo sapiens; identical to SEQ ID NO: 826442

SEQ ID NO: 826446 - protein, 204 aa, Homo sapiens; identical to SEQ ID NO: 826442

SEQ ID NO: 826447 - protein, 204 aa, Homo sapiens; identical to SEQ ID NO: 826442

SEQ ID NO: 826448 - protein, 157 aa, Homo sapiens
MWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQDLQSEDG

SEQ ID NO: 826449 - protein, 157 aa, Homo sapiens; identical to SEQ ID NO: 826448

SEQ ID NO: 826450 - protein, 69 aa, Homo sapiens
VVPAHHVGELGDAAGRADRLRDGRWTLGRVCSSGPAVPTPAAVAAMTGLALLYSGVFVAFWACALAVGS

SEQ ID NO: 826451 - protein, 272 aa, Homo sapiens
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQVMNPLGKPLCPCPQPSLTLLLEKLKCSPSLPITIDSPKQLPPPHFHLLVFSYRGLSIFVSDLVSLTTALFFFPPF

SEQ ID NO: 826452 - protein, 120 aa, Homo sapiens
MTGLALLYSGVFVAFWACALAVGEAGSWRAGAASRPSWPGRNSAGKWPAGNTGPPRALHPRLWGLAPARASDSDKGDPDFQLLEEGCGRVGAARAALPRPATIAVSPRSHVSLLSPLSCS

SEQ ID NO: 826453 - protein, 204 aa, Homo sapiens; identical to SEQ ID NO: 826442

SEQ ID NO: 826454 - protein, 158 aa, Homo sapiens
TTTKFAASTRSYLPVCGWGSLGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQDLQSEDG

SEQ ID NO: 826455 - protein, 164 aa, Homo sapiens
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIDLQSEDG

SEQ ID NO: 826456 - protein, 804 aa, Homo sapiens
MEEPGATPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPVRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 826457 - protein, 780 aa, Homo sapiens
MTAAAGFSGLPGSPGVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNGKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPVRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 826458 - protein, 792 aa, Homo sapiens [sequence omitted]

SEQ ID NO: 826459 - protein, 735 aa, Homo sapiens
MTAAAGFSGLPGSPGVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPVRGPLFPVDARGPFLRRGPPFPPPPPGAMFGVPPRWREGSGQL

SEQ ID NO: 826460 - protein, 761 aa, Homo sapiens
MEEPGATPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPVRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 826461 - protein, 798 aa, Homo sapiens
MTAAAGFSGLPGSPGVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPVRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 826462 - protein, 798 aa, Homo sapiens; identical to SEQ ID NO: 826461

SEQ ID NO: 826463 - protein, 724 aa, Homo sapiens
MLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPVRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 826464 - protein, 798 aa, Homo sapiens; identical to SEQ ID NO: 826461

SEQ ID NO: 826465 - protein, 520 aa, Homo sapiens
MTAAAGFSGLPGSPGVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIIFLMRKKAHDNGVGSGMLKKLMDLEGNCSPANYRTKVIGLKSLLVSQPWGRSPGRRVPRKRSLPTGGATPLWG

SEQ ID NO: 826466 - protein, 421 aa, Homo sapiens
TEAEGVMSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERAHLLARKCQLQKDVASYHALLDREESG

SEQ ID NO: 826467 - protein, 427 aa, Homo sapiens
TEAEGVMSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERAHLLARKCQLLMEKLPLFHEENTLPQQLTQEVA

SEQ ID NO: 826468 - protein, 421 aa, Homo sapiens; identical to SEQ ID NO: 826466

SEQ ID NO: 826469 - protein, 412 aa, Homo sapiens
TEAEGVMSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERTPCWTGRRAADGETSSFS

SEQ ID NO: 826470 - protein, 77 aa, Homo sapiens
RSSSLEKNEKESKRGLENTLHDAKHWHDMELQNLGAVVGRLEAELREIRAEAEQQQQERTPCWTGRRAADGETSSFS

SEQ ID NO: 826471 - protein, 776 aa, Homo sapiens
MEIGWMHNRRQRQVLVFFVLLSLSGAGAELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGTEFPLNHALDLDVGSNNVQNYKISPSSHFRVLIHEFRDGRKYPELVLDKELDREEEPQLRLTLTALDGGSPPRSGTAQVRIEVVDINDNAPEFEQPIYKVQIPENSPLGSLVATVSARDLDGGANGKISYTLFQPSEDISKTLEVNPMTGEVRLRKQVDFEMVTSYEVRIKATDGGGLSGKCTLLLQVVDVNDNPPQVTMSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALREFEFRVSATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPFLPLPEAAPGQTQANSLTVYLVVALASVSSLFLFSVLLFVAVRLCRRSRAASVGRCSMPEGPFPGRLVDVSGTGTLSQSYQYEVCLTGGSETSEFKFLKPIIPNFSP

SEQ ID NO: 826472 - protein, 161 aa, Homo sapiens
TRRPPAASGSGRKGWEKPSTRSTCVAVARGGSPLSLTTTSLCLAASRSLSSLAVRTSPLCAHTPTAQANSLTVYLVVALASVSSLFLFSVLLFVAVRLCRRSRAASVGRCSMPEGPFPGRLVDVSGTGTLSQSYQYEVCLTGGSETSEFKFLKPIIPNFSP

SEQ ID NO: 826473 - protein, 129 aa, Homo sapiens
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 826474 - protein, 115 aa, Homo sapiens
IRKYLTSRPTPPPIYSMSRISASWRSQTEETVATRASAPRNAPLGSAASPTSSLKCPGASSRSLWKTAITKRGWFQRMHLAHRVFRNQRRNFALSASYFMKSWVFLTIFSSFSMV

SEQ ID NO: 826475 - protein, 129 aa, Homo sapiens; identical to SEQ ID NO: 826473

SEQ ID NO: 826476 - protein, 71 aa, Homo sapiens
LFRRWFRAPPPVNQEKKKELVTRAALRGQTRNCGYPGISPEECASRKCCFSNFIFEVPWCFFPKSVEDCHY

SEQ ID NO: 826477 - protein, 450 aa, Homo sapiens
SSTPPGARAQRPRPRLSLPGRRWVSASLCSSTAPHSRVTLTPPSQLSGAAMAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDESSPPSASPAESEPQCDPSFKGDAGENTALLEAGRSDSRHGGPIS

SEQ ID NO: 826478 - protein, 441 aa, Homo sapiens
EVVPPGLGYCRPRRRSASLCSSTAPHSRVTLTPPSQLSGAAMAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDESSPPSASPAESEPQCDPSFKGDAGENTALLEAGRSDSRHGGPIS

SEQ ID NO: 826479 - protein, 450 aa, Homo sapiens; identical to SEQ ID NO: 826477

SEQ ID NO: 826480 - protein, 491 aa, Homo sapiens
SSTPPGARAQRPRPRLSLPGRRWVSASLCSSTAPHSRVTLTPPSQLSGAAMAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDESSPPSASPAESEPQCDPSFKGDAGENTALLELTFKKKAVSFADAAAAQGPLLPAMVNPTMFFHIAVDGEPLGCVSFEVRGLESKK

SEQ ID NO: 826481 - protein, 491 aa, Homo sapiens; identical to SEQ ID NO: 826480

SEQ ID NO: 826482 - protein, 478 aa, Homo sapiens
SSTPPGARAQRPRPRLSLPGRRWVSASLCSSTAPHSRVTLTPPSQLSGAAMAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDESSPPSASPAESEPQCDPSFKGDAGENTALLGERCANYKTIECGQEWWLTPVISVLWEFKVGGLLEFELSKSK

SEQ ID NO: 826483 - protein, 302 aa, Homo sapiens
SSTPPGARAQRPRPRLSLPGRRWVSASLCSSTAPHSRVTLTPPSQLSGAAMAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQVMMDNSEFCFLKDNS

SEQ ID NO: 826484 - protein, 121 aa, Homo sapiens
GLLLLNSRPLDLKGEPGDVQEMPAPESPPGRDPAANLSLALPDDDGSDESSPPSASPAESEPQCDPSFKGDAGENTALLGERCANYKTIECGQEWWLTPVISVLWEFKVGGLLEFELSKSK

SEQ ID NO: 826485 - protein, 450 aa, Homo sapiens; identical to SEQ ID NO: 826477

SEQ ID NO: 826486 - protein, 302 aa, Homo sapiens; identical to SEQ ID NO: 826483

SEQ ID NO: 826487 - protein, 491 aa, Homo sapiens; identical to SEQ ID NO: 826480

SEQ ID NO: 826488 - protein, 491 aa, Homo sapiens; identical to SEQ ID NO: 826480

SEQ ID NO: 826489 - protein, 302 aa, Homo sapiens; identical to SEQ ID NO: 826483

SEQ ID NO: 826490 - protein, 109 aa, Homo sapiens
SLRGGTEAIARLDQLEADYYDLQLQLYEVQFEILKCEELLLTAQLESIKRLISENNFQHFDLLYVIRKKIVSTKLNYVVIFGNIWHGHFISQNVCQVAKHTWAIVDTKN

SEQ ID NO: 826491 - protein, 116 aa, Homo sapiens
SLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKK

SEQ ID NO: 826492 - protein, 461 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEMLRKSALTLRKWLQPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 826493 - protein, 262 aa, Homo sapiens
MLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 826494 - protein, 252 aa, Homo sapiens
FGPFSQRVCRQNTGVVKTTPKSQNGKGKDSYQHCRHWTRRFGVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 826495 - protein, 299 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTMSTKLVVLVLFLLAEWRLVFSNPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 826496 - protein, 461 aa, Homo sapiens; identical to SEQ ID NO: 826492

SEQ ID NO: 826497 - protein, 461 aa, Homo sapiens; identical to SEQ ID NO: 826492

SEQ ID NO: 826498 - protein, 380 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 826499 - protein, 292 aa, Homo sapiens
DAVGRPTRRENGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 826500 - protein, 461 aa, Homo sapiens; identical to SEQ ID NO: 826492

SEQ ID NO: 826501 - protein, 450 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEMLRKSALTLRKWLQPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVREWTTLVFFFACGSFKLLVFKISTF

SEQ ID NO: 826502 - protein, 920 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826503 - protein, 871 aa, Homo sapiens [sequence omitted]

SEQ ID NO: 826504 - protein, 752 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKNVFVFYTAYGG

SEQ ID NO: 826505 - protein, 747 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826506 - protein, 674 aa, Homo sapiens
MLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826507 - protein, 920 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKV

SEQ ID NO: 826508 - protein, 384 aa, Homo sapiens [sequence omitted]

SEQ ID NO: 826509 - protein, 295 aa, Homo sapiens [sequence omitted]

SEQ ID NO: 826510 - protein, 871 aa, Homo sapiens [sequence omitted]

SEQ ID NO: 826511 - protein, 871 aa, Homo sapiens [sequence omitted]

SEQ ID NO: 826512 - protein, 115 aa, Homo sapiens
MQEVLLVFGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826513 - protein, 94 aa, Homo sapiens
IGRMLRLRRIQGTESGLAWQHSHDDRDDGVDYWAKRGRGRGTFQRGRGRFNFKKSGSSPKWTHDKYQGDGIVEDEEETMENNEEKKDRRKEEKE

SEQ ID NO: 826514 - protein, 113 aa, Homo sapiens
SYADRPGGWEGHMYHAMTTEMMVWIIGPKEEEVVVLFNVAEGALTSKNQVAVLNGLMTNTKGMGLLKMKKRPWKIMKKRRTDARKKRNNKYEVRLQQSRTCTHHFFYLIFVFK

SEQ ID NO: 826515 - protein, 871 aa, Homo sapiens [sequence omitted]

SEQ ID NO: 826516 - protein, 826 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFVSEKIIFDCLVGVYLRVLYIRKVIYMI

SEQ ID NO: 826517 - protein, 712 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHSCHCGHRKDHDYAIELGDPPTPRAEGEGYADKGEANADVRVREDAVQAEVHADRVSAHAG

SEQ ID NO: 826518 - protein, 339 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKR

SEQ ID NO: 826519 - protein, 384 aa, Homo sapiens [sequence omitted]

SEQ ID NO: 826520 - protein, 740 aa, Homo sapiens [sequence omitted]

SEQ ID NO: 826521 - protein, 871 aa, Homo sapiens [sequence omitted]

SEQ ID NO: 826522 - protein, 602 aa, Homo sapiens
MEAIYSECNPELLSSSLLIRRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826523 - protein, 408 aa, Homo sapiens
MARVNFLTRFPEKLTNSQNGHPVSFLNEFLTKRPGFPGPIKHTAGLASNTLVHILSKEREAKKFSNPIFEPPIKVATHRPRTKAHFQESQFNSNTIIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826524 - protein, 287 aa, Homo sapiens
MFLNQKVNNMTKNIFYFTLRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 826525 - protein, 121 aa, Homo sapiens
YISSCSSRSHSLSPFFISPHRTTVMTTEMMVWIIGPKEEEVVVLFNVAEGALTSKNQVAVLNGLMTNTKGMGLLKMKKRPWKIMKKRRTDARKKRNNKYEVRLQQSRTCTHHFFYLIFVFK

SEQ ID NO: 826526 - protein, 91 aa, Homo sapiens
NVRFKLMAKIKNNSTHMYTHDDRDDGVDYWAKRGRGRGTFQRGRGRFNFKKSGSSPKWTHDKYQGDGIVEDEEETMENNEEKKDRRKEEKE

SEQ ID NO: 826527 - protein, 826 aa, Homo sapiens; identical to SEQ ID NO: 826516

SEQ ID NO: 826528 - protein, 675 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHSLASPFPQLLQGVWRLTIERFSL

SEQ ID NO: 826529 - protein, 341 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKSHR

SEQ ID NO: 826530 - protein, 98 aa, Homo sapiens
PFGAERMSDRGRDAAATGRSWNQSQRGSAWKQSPAQSPLSLHDRSLPGPPTLFLPCPNPEKGSSHYPVGKHSLPWSACQEEGSHLGAGGLSDPILTAG

SEQ ID NO: 826531 - protein, 589 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 826532 - protein, 589 aa, Homo sapiens; identical to SEQ ID NO: 826531

SEQ ID NO: 826533 - protein, 589 aa, Homo sapiens; identical to SEQ ID NO: 826531

SEQ ID NO: 826534 - protein, 575 aa, Homo sapiens
MEAEETMECLQEFPEHHKMILDRLNEQREQDRFTDITLIVDGHHFKAHKAVLAACSKFFYKFFQEFTQEPLVEIEGTKKTQLPSEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGIEIVELQLSHVKDLFHCEKCNRSFKLFYHFKEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 826535 - protein, 589 aa, Homo sapiens; identical to SEQ ID NO: 826531

SEQ ID NO: 826536 - protein, 69 aa, Homo sapiens
MVEILPHHDILRESAGNRTYNGPAAEGEAAKGTHGTSPALQRGNTAAHPGPKHNETRRGNHEAHANLPD

SEQ ID NO: 826537 - protein, 589 aa, Homo sapiens; identical to SEQ ID NO: 826531

SEQ ID NO: 826538 - protein, 623 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGIEIVELQLSHVKDLFHCEKCNRSFKLFYHFKEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 826539 - protein, 623 aa, Homo sapiens; identical to SEQ ID NO: 826538

SEQ ID NO: 826540 - protein, 347 aa, Homo sapiens
MEAEETMECLQEFPEHHKMILDRLNEQREQDRFTDITLIVDGHHFKAHKAVLAACSKFFYKFFQEFTQEPLVEIEGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 826541 - protein, 351 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYLRESAWKQHLNCYHLEEGGVSKKQRTGKKIHVCQYCEKQFDHFGHFKEHLRKHTVLDAKKFTVMRPHLVRALPVATLQSPEAMQGITW

SEQ ID NO: 826542 - protein, 332 aa, Homo sapiens
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 826543 - protein, 128 aa, Homo sapiens
MLIADSQRIKFLSSNLNSWRELFPEKKTAAAAAARPVVTPTRGSLFPLLDLLSFFVEEASMGAQFSKTAAKGEAAAERPGEAAVASSPSKANGQVNSTCGCGHLFRVFLSFPPGGSQGSFVERSVAGF

SEQ ID NO: 826544 - protein, 332 aa, Homo sapiens; identical to SEQ ID NO: 826542

SEQ ID NO: 826545 - protein, 332 aa, Homo sapiens; identical to SEQ ID NO: 826542

SEQ ID NO: 826546 - protein, 332 aa, Homo sapiens; identical to SEQ ID NO: 826542

SEQ ID NO: 826547 - protein, 332 aa, Homo sapiens; identical to SEQ ID NO: 826542

SEQ ID NO: 826548 - protein, 332 aa, Homo sapiens; identical to SEQ ID NO: 826542

SEQ ID NO: 826549 - protein, 119 aa, Homo sapiens
MAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 826550 - protein, 299 aa, Homo sapiens [sequence omitted]

SEQ ID NO: 826551 - protein, 332 aa, Homo sapiens; identical to SEQ ID NO: 826542

SEQ ID NO: 826552 - protein, 210 aa, Homo sapiens
GTRRRTFLPRLFVGVVPGTGFGELVYNQGLILKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 826553 - protein, 332 aa, Homo sapiens; identical to SEQ ID NO: 826542

SEQ ID NO: 826554 - protein, 162 aa, Homo sapiens
LGVGPRILLATREISPFSSCLQCGYKSGIFLLLLFFSNYTWAPFFVLDFSTLFPSLLCCCFLISSTKIFLSGVYLIGSVLSSPPPPPPSLRCVLPLPLLPPRQPAQPPHRRPSPSAVQKPPQRRRQSKRASFCEIIEELFSPVCLLEWCQVLVLENLSTTRD

SEQ ID NO: 826555 - protein, 103 aa, Homo sapiens
MGAQFSKTAAKGEAAAERPGEAAVASSPSKANGQENGHVKVNGDASPAAAESGAKEELQANGSAPAADKEEPAAAAASSACAAPSQEAQPECSPEAPPAEAAE

SEQ ID NO: 826556 - protein, 332 aa, Homo sapiens; identical to SEQ ID NO: 826542

SEQ ID NO: 826557 - protein, 332 aa, Homo sapiens; identical to SEQ ID NO: 826542

SEQ ID NO: 826558 - protein, 423 aa, Homo sapiens
DSYLKPERLTATQKKRNRQKERQEIKTPGSRTHTHSHTLTHIETTPLPPVCVAAAAVAAAAAAAARPVVTPTRGSLFPLLDLLSFFVEEASMGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 826559 - protein, 332 aa, Homo sapiens; identical to SEQ ID NO: 826542

SEQ ID NO: 826560 - protein, 435 aa, Homo sapiens
QLWLCAFFQRAFAVSTSPWHLFSPKPPIKRGLAWLAFACYVSDFVFRALAEWLGGHCRTWGLQLCFGGVSRQRCPFPRSWGSLLGIHPRLPPHNGGGGVSMATGALGGSGALPVQGWGREWRRPGRFSDAPAFSAPEENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 826561 - protein, 119 aa, Homo sapiens; identical to SEQ ID NO: 826549

SEQ ID NO: 826562 - protein, 332 aa, Homo sapiens; identical to SEQ ID NO: 826542

SEQ ID NO: 826563 - protein, 332 aa, Homo sapiens; identical to SEQ ID NO: 826542

SEQ ID NO: 826564 - protein, 156 aa, Homo sapiens
LGVGPRILLATREISPFSSCLQCGYKSGIFLLLLFFSNYTWAPFFVLDFSTLFPSLLCCCFLISSTKIFLSGVYLIGSVLSSPPPPPPSLRCVLPLPLLPPPHRRPSPSAVQKPPQRRRQSKRASFCEIIEELFSPVCLLEWCQVLVLENLSTTRD

SEQ ID NO: 826565 - protein, 299 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 826566 - protein, 299 aa, Homo sapiens; identical to SEQ ID NO: 826565

SEQ ID NO: 826567 - protein, 283 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWGVSWMSWGCYREGRREASVQPCLRGLLPV

SEQ ID NO: 826568 - protein, 283 aa, Homo sapiens; identical to SEQ ID NO: 826567

SEQ ID NO: 826569 - protein, 319 aa, Homo sapiens
SVESSMDRDRAYQMHSIGPVYSCCSRMLRRRVCRHQRCPFAVLVRRLSAGMGSPLSGLPLVYRQYYYYSSMHSALARVWMAAEDVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 826570 - protein, 217 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKGPDHPGERGGRCYMGGLSIRESGGTQEDHILLPQ

SEQ ID NO: 826571 - protein, 67 aa, Homo sapiens
GRKQAPLRGPRKTRAETRSCSISSCSWWWRLRRHGSQRAGERQYRPLSPEFACARGVPQGALRPGRR

SEQ ID NO: 826572 - protein, 131 aa, Homo sapiens
MAQATRWLVLPASVPVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 826573 - protein, 299 aa, Homo sapiens; identical to SEQ ID NO: 826565

SEQ ID NO: 826574 - protein, 299 aa, Homo sapiens; identical to SEQ ID NO: 826565

SEQ ID NO: 826575 - protein, 299 aa, Homo sapiens; identical to SEQ ID NO: 826565

SEQ ID NO: 826576 - protein, 255 aa, Homo sapiens
MVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 826577 - protein, 231 aa, Homo sapiens
DRTWRATGTAVPGKLGSRRASYVSSIPTGLHVYLADVHALVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 826578 - protein, 139 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVS

SEQ ID NO: 826579 - protein, 246 aa, Homo sapiens
VTASQSPKMAGRSLCLTRSSVPGTPFPPPVQQPSTPGPDLLALEEEYKRLNAELQAKTADVVQQAKEIIRDRQEVRSRPVSTQMKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMR

SEQ ID NO: 826580 - protein, 163 aa, Homo sapiens
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMR

SEQ ID NO: 826581 - protein, 163 aa, Homo sapiens; identical to SEQ ID NO: 826580

SEQ ID NO: 826582 - protein, 163 aa, Homo sapiens; identical to SEQ ID NO: 826580

SEQ ID NO: 826583 - protein, 87 aa, Homo sapiens
VTASQSPKMAGRSLCLTVSSTPGSWGASGFRRLGRLTSFNFGSESLWLFYREAAFQGLRSRHPFSNPLHLDPTSSPWRKNISKKFGG

SEQ ID NO: 826584 - protein, 68 aa, Homo sapiens
AASTAWQRRFLLFVKIVISSLRPWAKKQPSPGHSRFVLLLAEPRQPCSPHLGYKRNGGVFLVSFRGNF

SEQ ID NO: 826585 - protein, 69 aa, Homo sapiens
GSLNRLAAAVSSLRENRDLISPSMGEKTAITRPFTLCAFVSRAQAALQPTSRFLCRRQQDAPGNVCEKG

SEQ ID NO: 826586 - protein, 68 aa, Homo sapiens; identical to SEQ ID NO: 826584

SEQ ID NO: 826587 - protein, 68 aa, Homo sapiens; identical to SEQ ID NO: 826584

SEQ ID NO: 826588 - protein, 114 aa, Homo sapiens
FSTTSLLSNYWFVGTQKVPKPLCEKGLAAKCFDMPVSLDGDTNTSTQEVVQYNWETGDDRFSFRSFRSGMWLSCEETVEEPALLHPQSWKQFRCLRSSGTAAAKGERCRSFIEQ

SEQ ID NO: 826589 - protein, 68 aa, Homo sapiens; identical to SEQ ID NO: 826584

SEQ ID NO: 826590 - protein, 160 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQMTVGCDQQCWGAWLSN

SEQ ID NO: 826591 - protein, 387 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826592 - protein, 373 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826593 - protein, 320 aa, Homo sapiens
NKRSQPQRGPIPISIYLKQKSGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826594 - protein, 206 aa, Homo sapiens
MTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826595 - protein, 251 aa, Homo sapiens [sequence omitted]

SEQ ID NO: 826596 - protein, 206 aa, Homo sapiens; identical to SEQ ID NO: 826594

SEQ ID NO: 826597 - protein, 99 aa, Homo sapiens
NRDKRLLPDFLWPSQDLTLPFPFTPDIAGTSDKWEKLEKDILDHLPAEVQEDYGQDYILAQRNFLLLINSLASKDFSPVLRDIQHAILAKSPFAYYTPG

SEQ ID NO: 826598 - protein, 387 aa, Homo sapiens; identical to SEQ ID NO: 826591

SEQ ID NO: 826599 - protein, 340 aa, Homo sapiens
RNHHMSPGLPLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826600 - protein, 392 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLSGIVDLPPHKKICLPGTSEGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826601 - protein, 311 aa, Homo sapiens
MLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826602 - protein, 325 aa, Homo sapiens
NKRSQPQRGPIPISIYLKQKSGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLSGIVDLPPHKKICLPGTSEGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 826603 - protein, 1053 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTR

SEQ ID NO: 826604 - protein, 1529 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826605 - protein, 1490 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRIRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826606 - protein, 1357 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826607 - protein, 219 aa, Homo sapiens
MAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826608 - protein, 1555 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826609 - protein, 1385 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERGRWSPSLDRRRPPSPRIQIQHASPENDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826610 - protein, 1306 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 826611 - protein, 1365 aa, Homo sapiens
GAQLLGVHPKGESQRASRGGGQATKMSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNDDKEVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTEQEKYNSSTKASLVVEERTRQMKMKVHRFKQTTGSGSSQELIASNIP

SEQ ID NO: 826612 - protein, 258 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGKPFCILTNRNLKSRIIGEKHTTETTNAPKKKVYCLVSYHVNMEQLFC

SEQ ID NO: 826613 - protein, 220 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQIHLFGVLLAILGNLVISISLNIQKYSHLQLAQQEHPRPYFKSVLWWGGVLQNASVVPSKSEALKLSFRNVTEIMALPVTDTQPNGAIRVM

SEQ ID NO: 826614 - protein, 453 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFGCFLSFLGVFLVTRNREKEHLQQSYIDFGNIPDTTPERKAWRETNVGQNTTRFT

SEQ ID NO: 826615 - protein, 400 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFG

SEQ ID NO: 826616 - protein, 288 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVIYIKWKPHRDKAQELFL

SEQ ID NO: 826617 - protein, 233 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQVRAAPQPPQPGGDAARAAGSGRLCASAAFLPALRKTPGLSEWEEVTCNVSRIDLSPPHPEARGSAQSSSPGHPALGVGAQVFGLDLSHPFLGPPGPDPASPAC

SEQ ID NO: 826618 - protein, 468 aa, Homo sapiens
AGRPREAADRRAPRGHLAPEEERRQRPARLGAPTAARGREPGGLGAPASPGHRAGSGCGAASSRCNRAGRRPQPEPEPERRERDLMAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFGCFLSFLGVFLVTRNREKEHLQQSYIDFGNIPGKQMLDKIQPDSHSLSYGTLPDGSDSTKSQSGEKKEV

SEQ ID NO: 826619 - protein, 112 aa, Homo sapiens
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 826620 - protein, 112 aa, Homo sapiens; identical to SEQ ID NO: 826619

SEQ ID NO: 826621 - protein, 112 aa, Homo sapiens; identical to SEQ ID NO: 826619

SEQ ID NO: 826622 - protein, 83 aa, Homo sapiens
CLPPPTPAVPLTMEKILILLLVALSVAYAAPGPRGIIINLTLYGIYYKCPCERGLTCEGDKTIVGSITNTNFGICHDAGRSKQ

SEQ ID NO: 826623 - protein, 157 aa, Homo sapiens
LSPATHTSCPTHHGEDPDPPACRPLCGLCSSWPPGDHYQPGWSVVAQSRLTAISASRVQMILLPQPPKKLGLQENGELCMNSAQCKSNCCQHSSALGLARCTSMASENSECSVKTLYGIYYKCPCERGLTCEGDKTIVGSITNTNFGICHDAGRSKQ

SEQ ID NO: 826624 - protein, 112 aa, Homo sapiens; identical to SEQ ID NO: 826619

SEQ ID NO: 826625 - protein, 83 aa, Homo sapiens; identical to SEQ ID NO: 826622

SEQ ID NO: 826626 - protein, 196 aa, Homo sapiens
AVPLTMEKILILLLVALSVAYAAPGPRGIIINLVRGSSGEAPPESPDEDFLSLDLDLCMSPPGLAGAGRSGILHPSVYFHVLSYASSQRPQERLISPSPAPTGACSEQQLNLAMRDLFFLFFLFETESCSVTRLECSGTISAHCNLCFPGSNDSPASASQEAGITGACHNAQLFFVFLVEIGFHHVAQASLKLLTS

SEQ ID NO: 826627 - protein, 199 aa, Homo sapiens
GSPRWVDRLSPGVQDQPGQHDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKCLA

SEQ ID NO: 826628 - protein, 468 aa, Homo sapiens
MAASSNSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 826629 - protein, 412 aa, Homo sapiens
MAASSNSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKK

SEQ ID NO: 826630 - protein, 332 aa, Homo sapiens
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 826631 - protein, 614 aa, Homo sapiens
NSASQWPGPVPDCPSQPPAGRCWRELIEPQPQLSQLSLVDVCQLGGLLGPQLVQPQQPAPCFAVPGSEPSRCSWQSGIELHHLCPLTGPGLLEASIECPSQGEIHPGRSGGGIRARERRVQDPDGGQEPGPPPSSPLRRRRSGEQQEVMRLLSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 826632 - protein, 322 aa, Homo sapiens
MTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 826633 - protein, 146 aa, Homo sapiens
AGPVARALPASGAGNRPQGQDSRRGRRMALSVLRLALLLLAVTFAGSARSGPGERGPPEKSGFGSQTGGGPCPAPGGLGDASLIPQFGLFSKYRTPNCSQYRLPGCPRHFNPVCGSDMSTYANECTLCMKIREGGHNIKIIRNGPC

SEQ ID NO: 826634 - protein, 109 aa, Homo sapiens [sequence omitted]

SEQ ID NO: 826635 - protein, 109 aa, Homo sapiens [sequence omitted]

SEQ ID NO: 826636 - protein, 109 aa, Homo sapiens [sequence omitted]

SEQ ID NO: 826637 - protein, 111 aa, Homo sapiens
AGPVARALPASGAGNRPQGQDSRRGRRMALSVLRLALLLLAVTFAASLIPQFGLFSKYRTPNCSQYRLPGCPRHFNPVCGSDMSTYANECTLCMKIREGGHNIKIIRNGPC

SEQ ID NO: 826638 - protein, 111 aa, Homo sapiens; identical to SEQ ID NO: 826637

SEQ ID NO: 826639 - protein, 134 aa, Homo sapiens
MALSVLRLALLLLAVTFAGSARSGPGERGPPEKSGFGSQTGGGPCPAPGGLGDGTRAPVTGGSPEDLPASLIPQFGLFSKYRTPNCSQYRLPGCPRHFNPVCGSDMSTYANECTLCMKIREGGHNIKIIRNGPC

SEQ ID NO: 826640 - protein, 131 aa, Homo sapiens
RAPSHERSLRVAQVTDRRGKTAGAGGGWRCRCCAWRCCSWQLPSQVALGAVLASGDLRRKAGLGVRPAADPALLRAASATPNCSQYRLPGCPRHFNPVCGSDMSTYANECTLCMKIREGGHNIKIIRNGPC

SEQ ID NO: 826641 - protein, 109 aa, Homo sapiens [sequence omitted]

SEQ ID NO: 826642 - protein, 134 aa, Homo sapiens
MALSVLRLALLLLAVTFAGSARSGPGERGPPEKSGFGSQTGGGPCPAPGGLGDGTRAPVTGGSPEDLPGKVVIILKSFEMDPADGAVYRKEDGETTFTGRLDKLHFPFFSFPVFLYMRFVNTHFLRAGMEDSHV

SEQ ID NO: 826643 - protein, 476 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 826644 - protein, 476 aa, Homo sapiens; identical to SEQ ID NO: 826643

SEQ ID NO: 826645 - protein, 446 aa, Homo sapiens [sequence omitted]

SEQ ID NO: 826646 - protein, 402 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQVALDRSFHIGCYKCEECGLLLSSEGECQGCYPLDGHILCKACSAWRIQELSATVTTDC

SEQ ID NO: 826647 - protein, 210 aa, Homo sapiens [sequence omitted]

SEQ ID NO: 826648 - protein, 561 aa, Homo sapiens
MSGPTWLPPKQPEPARAPQGRAIPRGTPGPPPAHGAGKAALVRQKSHPAVALTSVLPLQPPALAASSCPFPKPRRGEQPPALSWDPRFGGGGNERLERVAPQIYTPPVLRHPTFDFSSLNPALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 826649 - protein, 362 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVIKAPPAKGASSSQTFLDRMVKTIAKAYRY

SEQ ID NO: 826650 - protein, 421 aa, Homo sapiens
DRSPMCVMCTPAWRKRGCKYQHVSHLRTGPCQMQKACASPQPGSFPQMWVLEWGPCLRLLACVSPQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 826651 - protein, 182 aa, Homo sapiens [sequence omitted]

SEQ ID NO: 826652 - protein, 123 aa, Homo sapiens
MGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 826653 - protein, 476 aa, Homo sapiens; identical to SEQ ID NO: 826643

SEQ ID NO: 826654 - protein, 522 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECWLLRCHPGVTVSCAPMPSWSRILRAMGKAYHPGCFTCVVCHRGLDGIPFTVDATSQIHCIEDFHRKFAPRCSVCGGAIMPEPGQEET

SEQ ID NO: 826655 - protein, 451 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEPPRHPGATTGPRSSTPAP

SEQ ID NO: 826656 - protein, 210 aa, Homo sapiens [sequence omitted]

SEQ ID NO: 826657 - protein, 355 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVGEWLGLGGGSQWLDAGGFHPRW

SEQ ID NO: 826658 - protein, 298 aa, Homo sapiens
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFANVVGCEKNVVGDWAWDIYLCL

SEQ ID NO: 826659 - protein, 197 aa, Homo sapiens
DPPTSASQNAGTTGMSHRAQPAFSLVQCIKCVHIVVQPSPLSISRTLFHLPKLKATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 826660 - protein, 117 aa, Homo sapiens
TPPVLRHPTFDFSSLNPALQPHPRVNFCPLPSEQCYQAPGGPEDRGPAWVGSHGVLQHTQVRPGIVGWDMWDPPEPSLRDPGQEKAYGDLHSSCPGSILRGSLQTGGAFALEAWTPR

SEQ ID NO: 826661 - protein, 208 aa, Homo sapiens
EVTLEEDLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAPGKSLGYLAFSI

SEQ ID NO: 826662 - protein, 276 aa, Homo sapiens
RASPACPSSPPGCSGLVGPLLRPVVLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 826663 - protein, 276 aa, Homo sapiens; identical to SEQ ID NO: 826662

SEQ ID NO: 826664 - protein, 240 aa, Homo sapiens
EVTLEEDLTLSPSFPQRMSGFQINLNPLKEPLGFIKVLEWIASIFAFATCGGFKGQTEIQVNCPPAVTENQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 826665 - protein, 218 aa, Homo sapiens
RASPACPSSPPGCSGLVGPLLRPVVLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAYLAF

SEQ ID NO: 826666 - protein, 203 aa, Homo sapiens
RASPACPSSPPGCSGLVGPLLRPVVLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKYCVTLAL

SEQ ID NO: 826667 - protein, 237 aa, Homo sapiens
RASPACPSSPPGCSGLVGPLLRPVVLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVGYLAF

SEQ ID NO: 826668 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 826669 - protein, 276 aa, Homo sapiens; identical to SEQ ID NO: 826662

SEQ ID NO: 826670 - protein, 276 aa, Homo sapiens; identical to SEQ ID NO: 826662

SEQ ID NO: 826671 - protein, 259 aa, Homo sapiens
RASPACPSSPPGCSGLVGPLLRPVVLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVMEFRYVAQTGVQWHDLGTLQPPPPGFK

SEQ ID NO: 826672 - protein, 185 aa, Homo sapiens
EVTLEEDLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKYCVTLAL

SEQ ID NO: 826673 - protein, 220 aa, Homo sapiens
RASPACPSSPPGCSGLVGPLLRPVVLTLSPSFPQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAKYHRYI

SEQ ID NO: 826674 - protein, 223 aa, Homo sapiens
ERKWHGSPSGSPGLQACPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTYPILYLHAT

SEQ ID NO: 826675 - protein, 389 aa, Homo sapiens
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 826676 - protein, 257 aa, Homo sapiens
MAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 826677 - protein, 249 aa, Homo sapiens
ERKWHGSPSGSPGLQACPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 826678 - protein, 383 aa, Homo sapiens
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCGESPTPLGEGCS

SEQ ID NO: 826679 - protein, 445 aa, Homo sapiens
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 826680 - protein, 402 aa, Homo sapiens
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEGTCERRIVGKKKQA

SEQ ID NO: 826681 - protein, 79 aa, Homo sapiens
EDSLNVADLTSLRAPLDIPIPDPPPKDDEMETDKQEFVEDLGFWRVLLLIFVIALLSLGIAYYVSGVLPFVENQPELVH

SEQ ID NO: 826682 - protein, 93 aa, Homo sapiens
EDSLNVADLTSLRAPLDIPIPDPPPKDDEMETDKQEFVEDLGFWRVLLLIFVIALLSLGIAYYVSGVLPFVVACFLASNVCSQFLRIFLSAKQ

SEQ ID NO: 826683 - protein, 113 aa, Homo sapiens
RVWPLPSARHRLLEAAAVAAARSSRRYLARGLWAAPGLEPLDISCTVHCSTGGPVGLAGALRGEGARASHTFRGDWREPGRGSDRGSVMASSRSVCSRGPGRGLRGFSFALAG

SEQ ID NO: 826684 - protein, 3114 aa, Homo sapiens
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKNKQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKENLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGGGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESKGSENCKVQ

SEQ ID NO: 826685 - protein, 3114 aa, Homo sapiens [sequence omitted]

SEQ ID NO: 826686 - protein, 340 aa, Homo sapiens [sequence omitted]

SEQ ID NO: 826687 - protein, 3114 aa, Homo sapiens; identical to SEQ ID NO: 826684

SEQ ID NO: 826688 - protein, 2776 aa, Homo sapiens
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKNKQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKENLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKEQ

SEQ ID NO: 826689 - protein, 175 aa, Homo sapiens
MCIQCQKGKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKEQ

SEQ ID NO: 826690 - protein, 3114 aa, Homo sapiens; identical to SEQ ID NO: 826684

SEQ ID NO: 826691 - protein, 3114 aa, Homo sapiens; identical to SEQ ID NO: 826684

SEQ ID NO: 826692 - protein, 3088 aa, Homo sapiens
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKNKQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKENLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGGGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPSPKAGLESKGSENCKVQ

SEQ ID NO: 826693 - protein, 1708 aa, Homo sapiens
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKNKQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSEKKKKKKKKKFLGGWAPGKFLNPWVEPRGPRGYGYQWAHRGTTGGHRGRRNKKGVRIPHPNKKDAGGENKERLENKPQRGNNERHNRGAHITGRSTGELEFNLR

SEQ ID NO: 826694 - protein, 268 aa, Homo sapiens
AETASESAPEQRPRPPRLLRRDLERKTPARRPALASLPTGHTAPPPRPRCARPVRCTPACWRLRRRARPGLLLRATMSSRIARALALVVTLLHLTRLALSTCPAACHCPLEAPKCAPGVGLVRDGCGCCKVCAKQLNEDCSKTQPCDHTKGLECNFGASSTALKGICRAQSEGRPCEYNSRIILKTGKVSSPTVNISAHVLMAPWAAFLCVPKNYLSPTWAVPTLGWSKLPGSAARSGSVTRIVSRTPWRTRTASLARSWDSMPPRWS

SEQ ID NO: 826695 - protein, 167 aa, Homo sapiens
MEPRILYNPLQGQKCIVQTTSWSQCSKTCGTGISTRVTNDNPECRLVKETRICEVRPCGQPVYSSLKKGKKCSKTKKSPEPVRFTYAGCLSVKKYRPKYCGSCVDGRCCTPQLTRTVKMRFRCEDGETFSKNVMMIQSCKCNYNCPHANEAAFPFYRLFNDIHKFRD

SEQ ID NO: 826696 - protein, 167 aa, Homo sapiens; identical to SEQ ID NO: 826695

SEQ ID NO: 826697 - protein, 167 aa, Homo sapiens; identical to SEQ ID NO: 826695

SEQ ID NO: 826698 - protein, 268 aa, Homo sapiens; identical to SEQ ID NO: 826694

SEQ ID NO: 826699 - protein, 268 aa, Homo sapiens; identical to SEQ ID NO: 826694

SEQ ID NO: 826700 - protein, 268 aa, Homo sapiens; identical to SEQ ID NO: 826694

SEQ ID NO: 826701 - protein, 167 aa, Homo sapiens; identical to SEQ ID NO: 826695

SEQ ID NO: 826702 - protein, 268 aa, Homo sapiens; identical to SEQ ID NO: 826694

SEQ ID NO: 826703 - protein, 268 aa, Homo sapiens; identical to SEQ ID NO: 826694

SEQ ID NO: 826704 - protein, 167 aa, Homo sapiens; identical to SEQ ID NO: 826695

SEQ ID NO: 826705 - protein, 268 aa, Homo sapiens; identical to SEQ ID NO: 826694

SEQ ID NO: 826706 - protein, 268 aa, Homo sapiens; identical to SEQ ID NO: 826694

SEQ ID NO: 826707 - protein, 268 aa, Homo sapiens; identical to SEQ ID NO: 826694

SEQ ID NO: 826708 - protein, 167 aa, Homo sapiens; identical to SEQ ID NO: 826695

SEQ ID NO: 826709 - protein, 268 aa, Homo sapiens; identical to SEQ ID NO: 826694

SEQ ID NO: 826710 - protein, 167 aa, Homo sapiens; identical to SEQ ID NO: 826695

SEQ ID NO: 826711 - protein, 268 aa, Homo sapiens; identical to SEQ ID NO: 826694

SEQ ID NO: 826712 - protein, 268 aa, Homo sapiens; identical to SEQ ID NO: 826694

SEQ ID NO: 826713 - protein, 268 aa, Homo sapiens; identical to SEQ ID NO: 826694

SEQ ID NO: 826714 - protein, 268 aa, Homo sapiens; identical to SEQ ID NO: 826694

SEQ ID NO: 826715 - protein, 218 aa, Homo sapiens
MTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 826716 - protein, 218 aa, Homo sapiens; identical to SEQ ID NO: 826715

SEQ ID NO: 826717 - protein, 223 aa, Homo sapiens
MTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPISPFAYPLPSA

SEQ ID NO: 826718 - protein, 218 aa, Homo sapiens; identical to SEQ ID NO: 826715

SEQ ID NO: 826719 - protein, 226 aa, Homo sapiens
MTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIWGGGDQQINPTLP

SEQ ID NO: 826720 - protein, 206 aa, Homo sapiens
MTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRYSEWLEGRD

SEQ ID NO: 826721 - protein, 155 aa, Homo sapiens
MLRWTVHLEGGPRRVNHAAVAVGHRVYSFGGYCSGEDYETLRQIDVHIFNAVSLRWTKLPPVKSAIRGQAPVVPYMRYGHSTVLIDDTVLLWGGRNDTEGACNVLYAFDVNTHKWFTPRVSGTVPGARDGHSACVLGKIMYIFGGYEQQADCFSK

SEQ ID NO: 826722 - protein, 155 aa, Homo sapiens; identical to SEQ ID NO: 826721

SEQ ID NO: 826723 - protein, 218 aa, Homo sapiens; identical to SEQ ID NO: 826715

SEQ ID NO: 826724 - protein, 155 aa, Homo sapiens; identical to SEQ ID NO: 826721

SEQ ID NO: 826725 - protein, 218 aa, Homo sapiens; identical to SEQ ID NO: 826715

SEQ ID NO: 826726 - protein, 218 aa, Homo sapiens; identical to SEQ ID NO: 826715

SEQ ID NO: 826727 - protein, 218 aa, Homo sapiens
MIMDSYLYKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 826728 - protein, 81 aa, Homo sapiens
PPTIELVGQRAMCPPVRPGACFQLIGRQDESSLSVIPKSQSPLTDTASVSIDISTALYDSNLVPFYAEFIGLAPHLFIEYS

SEQ ID NO: 826729 - protein, 160 aa, Homo sapiens
MLRWTVHLEGGPRRVNHAAVAVGHRVYSFGGYCSGEDYETLRQIDVHIFNAVSLRWTKLPPVKSAIRGQAPVVPYMRYGHSTVLIDDTVLLWGGRNDTEGACNVLYAFDVNTHKWFTPRVSGTVPGARDGHSACVLGKIMYIFGGYEQQRTVFPCHAAGI

SEQ ID NO: 826730 - protein, 284 aa, Homo sapiens
MGRRKFLPPPLLSLLSSSLPLPICHPPVSTHHHHHQQQQQQQQQQQQQQQQQQQHHGNSGPPPPGAFPHPLEGGSSHHAHPYAMSPSLGSLRPYPPGTAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPGI

SEQ ID NO: 826731 - protein, 155 aa, Homo sapiens; identical to SEQ ID NO: 826721

SEQ ID NO: 826732 - protein, 284 aa, Homo sapiens; identical to SEQ ID NO: 826730

SEQ ID NO: 826733 - protein, 215 aa, Homo sapiens
MTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPISA

SEQ ID NO: 826734 - protein, 210 aa, Homo sapiens
MTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDISWGGGDQQINPTLP

SEQ ID NO: 826735 - protein, 218 aa, Homo sapiens; identical to SEQ ID NO: 826715

SEQ ID NO: 826736 - protein, 218 aa, Homo sapiens; identical to SEQ ID NO: 826715

SEQ ID NO: 826737 - protein, 218 aa, Homo sapiens; identical to SEQ ID NO: 826715

SEQ ID NO: 826738 - protein, 218 aa, Homo sapiens; identical to SEQ ID NO: 826715

SEQ ID NO: 826739 - protein, 167 aa, Homo sapiens
SLGVRGGGMADTVLFEFLHTEMVAELWAHDPDPGPGGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 826740 - protein, 181 aa, Homo sapiens
SLGVRGGGMADTVLFEFLHTEMVAELWAHDPDPGPGVSAGLRGEEAGATKGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 826741 - protein, 167 aa, Homo sapiens; identical to SEQ ID NO: 826739

SEQ ID NO: 826742 - protein, 107 aa, Homo sapiens
MQESGLSSSLFLAWPHGLSLVLPHQAAPGDAGLQGGAGCPQVLVQRPVGGGVPEADGQPAHQSPGGSTPACPSSFLLRARPREWEGNPPAPEQRLPGPAQSFPTGGR

SEQ ID NO: 826743 - protein, 124 aa, Homo sapiens
SLGVRGGGMADTVLFEFLHTEMVAELWAHDPDPGPGVSAGLRGEEAGATKGQKMSLSVLEGMGFRVGQALGERLPRETLAFREELDVLKFLCKDLWVAVFQKQMDSLRTNHQVGAPRPARPASS

SEQ ID NO: 826744 - protein, 181 aa, Homo sapiens; identical to SEQ ID NO: 826740

SEQ ID NO: 826745 - protein, 205 aa, Homo sapiens
ELLQPTRSEPCMGRKPLVAACPTPSVMLLVPSWSSPPVTPRLYLPFCIFLGRVPSFSAQPWEARAGPTLPRAQAPTPSLEALGPTRALEAKAVTPVVLRKGAFPTSAQSKTWVPAYPPCASNVQAPTPPTSLSFPQGTYVLQDNSFPLLLPMASGLQYLEEAPKFLAFTCGLLRGALYTLGIESVVTASVAALPVCKFQVVIPKS

SEQ ID NO: 826746 - protein, 191 aa, Homo sapiens
SLGVRGGGMADTVLFEFLHTEMVAELWAHDPDPGPGGQKMSLSVLEGMGFRVGQALGERLPRETLAFREELDVLKFLCKDLWVAVFQKQMDSLRTNHQGTYVLQDNSFPLLLPMASGLQYLEEAPKPWPHRPQETVGPLHFGVVLGIPGPRGHICSGSGYQIEVGVSEEAKGSQLRSGLWWDSRLGSVTAQ

SEQ ID NO: 826747 - protein, 181 aa, Homo sapiens; identical to SEQ ID NO: 826740

SEQ ID NO: 826748 - protein, 144 aa, Homo sapiens
LEACEEGAWRILCCLSFFTRRWWLSCGLTTPTPARGLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 826749 - protein, 144 aa, Homo sapiens; identical to SEQ ID NO: 826748

SEQ ID NO: 826750 - protein, 178 aa, Homo sapiens
SLGVRGGGMADTVLFEFLHTEMVAELWAHDPDPGPGVSAGLRGEEAGATKAFCRAGSEGGTWGQWFNCTLPGANCCTGKSREGSKQCQVHTGAVTSCRLLGQVVQTAVDLQLWTHMGSHVHFGLEDVPLLTWLLGCLSLVLVVVTNEIVKLHEIRVRVRYQKRQKLQFETKLGMNSPF

SEQ ID NO: 826751 - protein, 99 aa, Homo sapiens
SLGVRGGGMADTVLFEFLHTEMVAELWAHDPDPGPGVSAGLRGEEAGATKVTPLGERRARQASGFEPGPAPALQGNVWPWLPPLESGVRDGAGSGLLLN

SEQ ID NO: 826752 - protein, 181 aa, Homo sapiens; identical to SEQ ID NO: 826740

SEQ ID NO: 826753 - protein, 847 aa, Homo sapiens
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEESIRGHTLIKN

SEQ ID NO: 826754 - protein, 544 aa, Homo sapiens
LEDPVHFLHQVDGHSSKNDIHTLLKDLNSYLEDKVYLTGYNFTLADILLYYGLHRFIVSICIVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 826755 - protein, 901 aa, Homo sapiens
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 826756 - protein, 847 aa, Homo sapiens; identical to SEQ ID NO: 826753

SEQ ID NO: 826757 - protein, 901 aa, Homo sapiens; identical to SEQ ID NO: 826755

SEQ ID NO: 826758 - protein, 923 aa, Homo sapiens
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFFLKVIKPLAFRDLLEHTHLFMHASASVLNLGSKLSKNSSR

SEQ ID NO: 826759 - protein, 328 aa, Homo sapiens
FTLERNLISAMSVENHLVLVYPLSSIREFTLERNLMVVVCVGKPLVKRDILFSISEFTQERNPMNVVSVEKLSARVLILFTIKEHTMVRSPMNVMNVIKPSVCFLPLFNIREYIMETNPMSVTNVGRPLARGHTLFSIRGVTLVRNPMSVMSVGKPLGRYPPKLSMREHTMERSPMSAVTVGRPSARVHTLSTIKEFTLERIPMSAVNVGRPSMFVPLSFSITEFILVRNLMNVVTVARRSVSIHNLSNIREFTLERNPTCAMSVRNPSVHAYPLSNTREFTLERNPMYVPNVENPSDKALTLFNIREFTVGSNLIRVIDVKKPSVRE

SEQ ID NO: 826760 - protein, 328 aa, Homo sapiens; identical to SEQ ID NO: 826759

SEQ ID NO: 826761 - protein, 308 aa, Homo sapiens
WKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRKHS

SEQ ID NO: 826762 - protein, 308 aa, Homo sapiens; identical to SEQ ID NO: 826761

SEQ ID NO: 826763 - protein, 308 aa, Homo sapiens; identical to SEQ ID NO: 826761

SEQ ID NO: 826764 - protein, 308 aa, Homo sapiens; identical to SEQ ID NO: 826761

SEQ ID NO: 826765 - protein, 308 aa, Homo sapiens; identical to SEQ ID NO: 826761

SEQ ID NO: 826766 - protein, 369 aa, Homo sapiens
WKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRYFFTPLDSPRAGSRWSSYAQLLPPPPPPLVEHSCDADTANLQYPHPRRRYLSRPLNPLPENEGI

SEQ ID NO: 826767 - protein, 271 aa, Homo sapiens
GKGPVAAFIDQSNIFLTDPKIFLGQWREEPKMPLLLLGETEPLKLERDCRSPVDPWAAASPDLALACLCHCQDLSSGAFPNRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEEPGEDEDS

SEQ ID NO: 826768 - protein, 175 aa, Homo sapiens
AGAAAGRGVLGLEIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEEPGEDEDS

SEQ ID NO: 826769 - protein, 240 aa, Homo sapiens
GKGPVAAFIDQSNIFLTDPKIFLGQWREEPKMPLLLLGETEPLKLERDCRSPVDPWAAASPDLALACLCHCQDLSSGAFPNRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKEEEGETATEETEEIAMEGAEGEAEEEEETAEGEEEPGEDEDS

SEQ ID NO: 826770 - protein, 132 aa, Homo sapiens
MIRKKQQEVVGFLEANKIDFKELDIAGDEDNRRWMRENVPGEKKPQNGIPLPPQIFNEEQYCGDFDSFFSAKEENIIYSFLGLAPPPDSKEEEGETATEETEEIAMEGAEGEAEEEEETAEGEEEPGEDEDS

SEQ ID NO: 826771 - protein, 108 aa, Homo sapiens
MRENVPGEKKPQNGIPLPPQIFNEEQYCGDFDSFFSAKEENIIYSFLGLAPPPDSKGSEKAEEGGETEAQKEGSEDTEEIAMEGAEGEAEEEEETAEGEEEPGEDEDS

SEQ ID NO: 826772 - protein, 271 aa, Homo sapiens; identical to SEQ ID NO: 826767

SEQ ID NO: 826773 - protein, 108 aa, Homo sapiens
GKGPVAAFIDQSNIFLTDPKIFLGQWREEPKMPLLLLGETEPLKLERDCRSPVDPWAAASPDLALACLCHCQDLSSGAFPNRGVLGGVLFPTVEMVIKGIREAEKVRT

SEQ ID NO: 826774 - protein, 271 aa, Homo sapiens; identical to SEQ ID NO: 826767

SEQ ID NO: 826775 - protein, 129 aa, Homo sapiens
MRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEEPGEDEDS

SEQ ID NO: 826776 - protein, 271 aa, Homo sapiens; identical to SEQ ID NO: 826767

SEQ ID NO: 826777 - protein, 252 aa, Homo sapiens
GKGPVAAFIDQSNIFLTDPKIFLGQWREEPKMPLLLLGETEPLKLERDCRSPVDPWAAASPDLALACLCHCQDLSSGAFPNRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNKMEAMKQHFKCLSTNQTQQNTLA

SEQ ID NO: 826778 - protein, 271 aa, Homo sapiens; identical to SEQ ID NO: 826767

SEQ ID NO: 826779 - protein, 102 aa, Homo sapiens
MEGRRYINTTDPSIMTNPERTPTEPTRADRHEPSDGRGAESTAQGRRTANCDHDPDTPARGHTRRATHDRDSTTPQTESPHRNERPHRTGRPTEKPDGPADD

SEQ ID NO: 826780 - protein, 127 aa, Homo sapiens
MGDKPIWEQIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKNINDAWVCTNDMFRLALHNFG

SEQ ID NO: 826781 - protein, 127 aa, Homo sapiens; identical to SEQ ID NO: 826780

SEQ ID NO: 826782 - protein, 127 aa, Homo sapiens; identical to SEQ ID NO: 826780

SEQ ID NO: 826783 - protein, 127 aa, Homo sapiens; identical to SEQ ID NO: 826780

SEQ ID NO: 826784 - protein, 127 aa, Homo sapiens; identical to SEQ ID NO: 826780

SEQ ID NO: 826785 - protein, 127 aa, Homo sapiens; identical to SEQ ID NO: 826780

SEQ ID NO: 826786 - protein, 127 aa, Homo sapiens; identical to SEQ ID NO: 826780

SEQ ID NO: 826787 - protein, 138 aa, Homo sapiens
GRQGGRDSRPQTALGCRCRCRHRASPSGECRGQHAGAGAGPQEPLSGLPGGSAESPRAAPPLPPPRRPEAARGPGHVSRAAPPPAGPVRRRPGVTHREPAGRLSGPYRAGGWCTGLRHGQAFFSSQDRPDGALGPRPV

SEQ ID NO: 826788 - protein, 127 aa, Homo sapiens; identical to SEQ ID NO: 826780

SEQ ID NO: 826789 - protein, 127 aa, Homo sapiens; identical to SEQ ID NO: 826780

SEQ ID NO: 826790 - protein, 127 aa, Homo sapiens; identical to SEQ ID NO: 826780

SEQ ID NO: 826791 - protein, 127 aa, Homo sapiens; identical to SEQ ID NO: 826780

SEQ ID NO: 826792 - protein, 127 aa, Homo sapiens; identical to SEQ ID NO: 826780

SEQ ID NO: 826793 - protein, 126 aa, Homo sapiens
RARYPTMVIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKNINDAWVCTNDMFRLALHNFG

SEQ ID NO: 826794 - protein, 127 aa, Homo sapiens; identical to SEQ ID NO: 826780

SEQ ID NO: 826795 - protein, 101 aa, Homo sapiens
TKAEWFLSLGNCAGLCSQPLGKLPVAPAPQSLAPPQSCLGHLNPLNSALPTPPCRTRCCGCCTCGRSAETRTSSTPTRPGGSWTSRPPAPSRFSECGAGAR

SEQ ID NO: 826796 - protein, 452 aa, Homo sapiens
MAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILRVDPAFDKDRFLKQCENDIIPNVLEAMISGELDILKDWCYEATYSQLAHPIQQAKALGLQFHSRILDIDNVDLAMGKMMEQGPVLIITFQAQLVMVVRNPKGEVVEGDPDKVLRMLYVWALCRDQDELNPYAAWRLLDISASSTEQIL

SEQ ID NO: 826797 - protein, 452 aa, Homo sapiens; identical to SEQ ID NO: 826796

SEQ ID NO: 826798 - protein, 157 aa, Homo sapiens [sequence omitted]

SEQ ID NO: 826799 - protein, 422 aa, Homo sapiens
MAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILRVDPAFDKDRFLKQCENDIIPNVLEAMISGELDILKDWCYEATYSLLHWPESVPGPCPLWKVTGHTRGPVSCLSEANAVWLRHFCAFMFNFMRATGLCRLSLRDDSDLLATEDSLAHT

SEQ ID NO: 826800 - protein, 531 aa, Homo sapiens
APVAEDWVKLAWKLDTGGPGLLPGKKVALTVARCPKRASPCSWIGCTFAWPPFKLPTRSSPFFVFSLEKSKEVSKEEDRDVIFLSVSPMEGTVVTGSCRIRHELAEAADDATGPRREKVTRFSNMAAAALRSGWCRCPRRCLGSGIQFLSSHNLPHGSTYQMRRPGGELPLSKSYSSGNRKGFLSGLLDNVKQELAKNKEMKESIKKFRDEARRLEESDRSRHLPPPHRIRPRLQDPVEAAPSPGTPPAAHPSLSLPPAVRRQPVPWWALQSEMWSPGGTEDMGSLREPELGPHLPGLDFLTRLKAGSPATFLFLHQVPGGSPCGVPPGWSPAGRPPPVPRPEPGTDTSRDGPGGDTQCHSSTRAPQVAAGGVLRKLPTPHHWRMFPGPRLLPEKPTLVLVLIFPSFLAMISGELDILKDWCYEATYSQLAHPIQQAKALGLQFHSRILDIDNVDLAMGKMMEQGPVLIITFQAQLVMVVRNPKGEVVEGDPDKVLRMLYVWALCRDQDELNPYAAWRLLDISASSTEQIL

SEQ ID NO: 826801 - protein, 218 aa, Homo sapiens
MEGTVVTGSCRIRHELAEAADDATGPRREKVTRFSNMAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQL

SEQ ID NO: 826802 - protein, 576 aa, Homo sapiens
APVAEDWVKLAWKLDTGGPGLLPGKKVALTVARCPKRASPCSWIGCTFAWPPFKLPTRSSPFFVFSLEKSKEVSKEEDRDVIFLSVSPMEGTVVTGSCRIRHELAEAADDATGPRREKVTRFSNMAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILRVDPAFDKDRFLKQCENDIIPNVLEAMISGELDILKDWCYEATYSQLAHPIQQAKALGLQFHSRILDIDNVDLAMGKMMEQGPVLIITFQAQLVMVVRNPKGEVVEGDPDKVLRMLYVWALCRDQDELNPYAAWRLLDISASSTEQIL

SEQ ID NO: 826803 - protein, 452 aa, Homo sapiens; identical to SEQ ID NO: 826796

SEQ ID NO: 826804 - protein, 408 aa, Homo sapiens
MAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILRVDPAFDKDRFLKQCENDIIPNVLEVGATPPGPLPGGRSWLHHLPRRSRHPGCCQGTLLPRLFSEEAGCTRAPARLQLPHELCPKPFLGLTGTSGTSRSVSLTP

SEQ ID NO: 826805 - protein, 418 aa, Homo sapiens
SPQDAGGAWTPSAQSGQASGRPFMGLSILGPAGLRPTSSSSSSFPYPSRHFGQGWEVVRMGAMPQNSSLSTAVPSGMGDGCQVFLATRPLPLTAFTTSIRLLPALLPAPGTSLPLIGSGPGSRILWKQLPAQARPLQPTPPSRCPQQLGGSRSHGGPCSPKCGPLGGQRTWAHCGSRSWVLISLAWIPDQAESWVPSHLSLPPPGSRGSPCGVPPGWSPAGRPPPVPRPEPGTDTSRDGPGGDTQCHSSTRAPQVAAGGVLRKLPTPHHWRMFPGPRLLPEKPTLVLVLIFPSFLAMISGELDILKDWCYEATYSQLAHPIQQAKALGLQFHSRILDIDNVDLAMGKMMEQGPVLIITFQAQLVMVVRNPKGEVVEGDPDKVLRMLYVWALCRDQDELNPYAAWRLLDISASSTEQIL

SEQ ID NO: 826806 - protein, 376 aa, Homo sapiens
MANSANTNTVPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 826807 - protein, 255 aa, Homo sapiens [sequence omitted]

SEQ ID NO: 826808 - protein, 376 aa, Homo sapiens; identical to SEQ ID NO: 826806

SEQ ID NO: 826809 - protein, 393 aa, Homo sapiens
FASSSPQRTAADFRLGANHVITRALESPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 826810 - protein, 409 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 826811 - protein, 282 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDVSEEGAR

SEQ ID NO: 826812 - protein, 114 aa, Homo sapiens
MRILLKTALAASGRREVLFIPTVSPGPSGMTMFSCGGGCVIAPAVFQSLTSPSCQPGGDNHPPRVSLGSFFKSPPTNRILAGKGSSVRKCQIWFLNKVQPCNEAATSAQRDYKN

SEQ ID NO: 826813 - protein, 409 aa, Homo sapiens; identical to SEQ ID NO: 826810

SEQ ID NO: 826814 - protein, 411 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSETMKSLENFW

SEQ ID NO: 826815 - protein, 285 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDVRGPHPQASH

SEQ ID NO: 826816 - protein, 285 aa, Homo sapiens
MGFGLYLPGHLRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSETMKSLENFW

SEQ ID NO: 826817 - protein, 409 aa, Homo sapiens; identical to SEQ ID NO: 826810

SEQ ID NO: 826818 - protein, 411 aa, Homo sapiens; identical to SEQ ID NO: 826814

SEQ ID NO: 826819 - protein, 411 aa, Homo sapiens; identical to SEQ ID NO: 826814

SEQ ID NO: 826820 - protein, 312 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRP

SEQ ID NO: 826821 - protein, 285 aa, Homo sapiens; identical to SEQ ID NO: 826816

SEQ ID NO: 826822 - protein, 109 aa, Homo sapiens
MWETLSPKSTQAPASKQSSGMWKMIISPTSGTTAGRRSSRRKACCTGHATLATQICTTEHRRWAPPAAADCQRCRPPCMDSPGPATPPRSKYEPGLPPPCNSWQLWPWS

SEQ ID NO: 826823 - protein, 409 aa, Homo sapiens; identical to SEQ ID NO: 826810

SEQ ID NO: 826824 - protein, 409 aa, Homo sapiens; identical to SEQ ID NO: 826810

SEQ ID NO: 826825 - protein, 275 aa, Homo sapiens
THASADAWVDPRVRVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSETMKSLENFW

SEQ ID NO: 826826 - protein, 285 aa, Homo sapiens; identical to SEQ ID NO: 826816

SEQ ID NO: 826827 - protein, 150 aa, Homo sapiens [sequence omitted]

SEQ ID NO: 826828 - protein, 409 aa, Homo sapiens; identical to SEQ ID NO: 826810

SEQ ID NO: 826829 - protein, 327 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDRKACCTGHATLATQICTTEHRRWAPPAAADCQRCRPPCMDSPGPATPPRSKL

SEQ ID NO: 826830 - protein, 157 aa, Homo sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 826831 - protein, 157 aa, Homo sapiens; identical to SEQ ID NO: 826830

SEQ ID NO: 826832 - protein, 157 aa, Homo sapiens; identical to SEQ ID NO: 826830

SEQ ID NO: 826833 - protein, 157 aa, Homo sapiens; identical to SEQ ID NO: 826830

SEQ ID NO: 826834 - protein, 157 aa, Homo sapiens; identical to SEQ ID NO: 826830

SEQ ID NO: 826835 - protein, 119 aa, Homo sapiens
MVVRSVWIMQASLLGEPEEVALGPMGVVAATLEVVGTRAMGVAGIMTVDLEGMDMDMDVPETIMAETRVVMTATQEEITETIMTTEMRHAHNIDTQGIISDPGSSFQMAVFITRFLELH

SEQ ID NO: 826836 - protein, 118 aa, Homo sapiens [sequence omitted]

SEQ ID NO: 826837 - protein, 119 aa, Homo sapiens; identical to SEQ ID NO: 826835

SEQ ID NO: 826838 - protein, 211 aa, Homo sapiens
MSSEEGKLFVGGLNFNTDEQALEDHFSSFGPISEVVVVKDRETQRSRGFGFITFTNPEHASVAMRAMNGEVVESADLWAWPGEDLVSLLTWTLKPQTKRGVCLALIVGQLRGVGRRTQPEFSQDSLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 826839 - protein, 179 aa, Homo sapiens
MSSEEGKLFVGGLNFNTDEQALEDHFSSFGPISEVVVVKDRETQRSRGFGFITFTNPDLWMVVRSVWIMQASLLGEPEEVALGPMGVVAATLEVVGTRAMGVAGIMTVDLEGMDMDMDVPETIMAETRVVMTATQEEITETIMTTEMRHAHNIDTQGIISDPGSSFQMAVFITRFLELH

SEQ ID NO: 826840 - protein, 118 aa, Homo sapiens [sequence omitted]

SEQ ID NO: 826841 - protein, 118 aa, Homo sapiens [sequence omitted]

SEQ ID NO: 826842 - protein, 157 aa, Homo sapiens; identical to SEQ ID NO: 826830

SEQ ID NO: 826843 - protein, 157 aa, Homo sapiens; identical to SEQ ID NO: 826830

SEQ ID NO: 826844 - protein, 67 aa, Homo sapiens
AAAYYYYYYCSEFKLLNDVREHDYPGVFSNSDHQTDYIEELALKCLQMSFFFLILEEKIFCCVSYSA

SEQ ID NO: 826845 - protein, 157 aa, Homo sapiens; identical to SEQ ID NO: 826830

SEQ ID NO: 826846 - protein, 157 aa, Homo sapiens; identical to SEQ ID NO: 826830

SEQ ID NO: 826847 - protein, 118 aa, Homo sapiens [sequence omitted]

SEQ ID NO: 826848 - protein, 119 aa, Homo sapiens; identical to SEQ ID NO: 826835

SEQ ID NO: 826849 - protein, 119 aa, Homo sapiens; identical to SEQ ID NO: 826835

SEQ ID NO: 826850 - protein, 119 aa, Homo sapiens; identical to SEQ ID NO: 826835

SEQ ID NO: 826851 - protein, 157 aa, Homo sapiens; identical to SEQ ID NO: 826830

SEQ ID NO: 826852 - protein, 198 aa, Homo sapiens
RPRKFEMADGSLTGGGLEAAAMAPERTGWAVEQELASLEKVFQKKLKSKMQEPFAISGESWRFLITGCSCEQPNADDTGCTCRQPTVTCARITSTDHPYFQKILNEDMVAGDKSNYVPLKNRDDYLWIQLHIENQHCVPCGLDLWYTTCDPYRKWEPDSLSIDYLDTQKQLSVACTTSGYQQDLLPFLTRQQRSYQQL

SEQ ID NO: 826853 - protein, 678 aa, Homo sapiens
RPRKFEMADGSLTGGGLEAAAMAPERTGWAVEQELASLEKGLFQDEDSCSDCSYRDKPGSSLQSFMPEGKTFFPEIFQTNQLLFYERFRAYQDYILADCKASEVQEFTAEFLEKVLEPSGWRAVWHTNVFKVLVEITDVDFAALKAVVRLAEPYLCDSQVSTFTMECMKELLDLKEHRLPLQELWVVFDDSGVFDQTALAIEHVRFFYQNIWRSWDEEEEDEYDYFVRCVEPRLRLHYDILEDRVPSGLIVDYHNLLSQCEESYRKFLNLRSSLSNCNSDSEQENISMVEGLKLYSEMEQLKQKLKLIENPLLRYVFGYQKNSNIQAKGVRSSGQKITHVVSSTMMAGLLRSLLTDRLCQEPGEEEREIQFHSDPLSAINACFEGDTVIVCPGHYVVHGTFSIADSIELEGYGLPDDIVIEKRGKGDTFVDCTGADIKISGIKFVQHDAVEGILIVHRGKTTLENCVLQCETTGVTVRTSAEFLMKNSDLYGAKGAGIEIYPGSQCTLSDNGIHHCKEGILIKDFLDEHYDIPKISMVNNIIHNNEGYGVVLVKPTIFSDLQENAEDGTEENKALKIQTSGEPDVAERVDLEELIECATGKMELCARTDPSEQVEGNCEIVNELIAASTQKGQIKKKRLSELGITQADDNLMSQEMFVGIVGNQFKWNGKGSFGTFLF

SEQ ID NO: 826854 - protein, 678 aa, Homo sapiens; identical to SEQ ID NO: 826853

SEQ ID NO: 826855 - protein, 600 aa, Homo sapiens
RPRKFEMADGSLTGGGLEAAAMAPERTGWAVEQELASLEKGLFQDEDSCSDCSYRDKPGSSLQSFMPEGKTFFPEIFQTNQLLFYERFRAYQDYILADCKASEVQEFTAEFLEKVLEPSGWRAVWHTNVFKVLVEITDVDFAALKAVVRLAEPYLCDSQVSTFTMECMKELLDLKEHRLPLQELWVVFDDSGVFDQTALAIEHVRFFYQNIWRSWDEEEEDEYDYFVRCVEPRLRLYVFGYQKNSNIQAKGVRSSGQKITHVVSSTMMAGLLRSLLTDRLCQEPGEEEREIQFHSDPLSAINACFEGDTVIVCPGHYVVHGTFSIADSIELEGYGLPDDIVIEKRGKGDTFVDCTGADIKISGIKFVQHDAVEGILIVHRGKTTLENCVLQCETTGVTVRTSAEFLMKNSDLYGAKGAGIEIYPGSQCTLSDNGIHHCKEGILIKDFLDEHYDIPKISMVNNIIHNNEGYGVVLVKPTIFSDLQENAEDGTEENKALKIQTSGEPDVAERVDLEELIECATGKMELCARTDPSEQVEGNCEIVNELIAASTQKGQIKKKRLSELGITQADDNLMSQEMFVGIVGNQFKWNGKGSFGTFLF

SEQ ID NO: 826856 - protein, 354 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 826857 - protein, 354 aa, Homo sapiens; identical to SEQ ID NO: 826856

SEQ ID NO: 826858 - protein, 354 aa, Homo sapiens; identical to SEQ ID NO: 826856

SEQ ID NO: 826859 - protein, 302 aa, Homo sapiens [sequence omitted]

SEQ ID NO: 826860 - protein, 354 aa, Homo sapiens; identical to SEQ ID NO: 826856

SEQ ID NO: 826861 - protein, 354 aa, Homo sapiens; identical to SEQ ID NO: 826856

SEQ ID NO: 826862 - protein, 354 aa, Homo sapiens; identical to SEQ ID NO: 826856

SEQ ID NO: 826863 - protein, 354 aa, Homo sapiens; identical to SEQ ID NO: 826856

SEQ ID NO: 826864 - protein, 145 aa, Homo sapiens
AYIKSVDVGAKGRVGDSNYLLCAQYSEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 826865 - protein, 248 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGFDDHRNPKYEDEINKRTEMENEFVLIKKGLM

SEQ ID NO: 826866 - protein, 113 aa, Homo sapiens
MFPGAAYGIQENCMRGVTFGLEAKIQVNICQMGSGKQSSTERKQNLLGISEQVDFLQLSTVLRRSGQVQSVGSQHSQQLGVGVLWLPTALKPTALTTASFSIFRTHPSLPGGC

SEQ ID NO: 826867 - protein, 329 aa, Homo sapiens
MPWVCTQARSPDGINTPPTEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826868 - protein, 106 aa, Homo sapiens
SLSRGAGCGGAVVQAPLVQVRVQGRQPGRPHALVRAVAVQTTWLCRACFPSPGGAALLFLLHSVISVFFSFFPFSVPHPHLTLIGSHSSVLSAPAVPESLSLPWAC

SEQ ID NO: 826869 - protein, 881 aa, Homo sapiens
VCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826870 - protein, 599 aa, Homo sapiens
MVPCVRINPLEYSWSQFLPVPPPRPDPLLGLPRRREAGGRPGSPGGQLSADPGPLYHASCFLFQSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826871 - protein, 536 aa, Homo sapiens
MSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826872 - protein, 565 aa, Homo sapiens
MLSTHRCDWFNKGLAIFSWASPRCLVPPSQSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826873 - protein, 496 aa, Homo sapiens
MVPCVRINPLEYSWSQFLPVPPPRPDPLLGLPRRREAGGRPGSPGGQLSADPGPLYHASCFLFQSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826874 - protein, 599 aa, Homo sapiens; identical to SEQ ID NO: 826870

SEQ ID NO: 826875 - protein, 774 aa, Homo sapiens
RRSPRWGLPGTRPGRTLQARCMEKKAARPHARRWPADEAQRAGGVQARLAQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826876 - protein, 822 aa, Homo sapiens
MNFQAGGGQSPQQQQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826877 - protein, 360 aa, Homo sapiens
MNFQAGGGQSPQQQQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTICATVSNFSSTKRPFQLLPN

SEQ ID NO: 826878 - protein, 599 aa, Homo sapiens; identical to SEQ ID NO: 826870

SEQ ID NO: 826879 - protein, 676 aa, Homo sapiens
MCPRAKIRQGTDLKRCTYYETCATYGLNVERVFQDVGIIDSAAPAVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826880 - protein, 360 aa, Homo sapiens; identical to SEQ ID NO: 826877

SEQ ID NO: 826881 - protein, 360 aa, Homo sapiens; identical to SEQ ID NO: 826877

SEQ ID NO: 826882 - protein, 360 aa, Homo sapiens; identical to SEQ ID NO: 826877

SEQ ID NO: 826883 - protein, 93 aa, Homo sapiens
MSVLPLCVLPLLLASCSHLSTFLWPPSLACCLETLVGIPFSRHRSLGLIPAPRCLPLPAAIPTSLCSPPFHSLHSLPRCPLLKVLGHPQVAWS

SEQ ID NO: 826884 - protein, 66 aa, Homo sapiens
MPYDLGGWLLVSDQTSVLQGILLKRSGKSLNKEWKKKYVTLCDNGLLTYHPSLHVSLGGGASWGSM

SEQ ID NO: 826885 - protein, 875 aa, Homo sapiens
MNFQAGGGQSPQQQQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826886 - protein, 115 aa, Homo sapiens
MVKPRFHYKYKNERGVLMCIECSGIHRHLGAHLSRVRSLDLDDWPPELLAVMTAMGNALANSVWEGALGGIDKQLVFIDATQSKDKQKKYINKNPSKAQTGSGTCMRRSYEHRVP

SEQ ID NO: 826887 - protein, 599 aa, Homo sapiens; identical to SEQ ID NO: 826870

SEQ ID NO: 826888 - protein, 881 aa, Homo sapiens; identical to SEQ ID NO: 826869

SEQ ID NO: 826889 - protein, 536 aa, Homo sapiens; identical to SEQ ID NO: 826871

SEQ ID NO: 826890 - protein, 881 aa, Homo sapiens; identical to SEQ ID NO: 826869

SEQ ID NO: 826891 - protein, 1248 aa, Homo sapiens
VCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVGIIDSAVPCSGPEGSGLAKEAATGHRALQVTAQLAQPLGRVRRLHPGRAHQPGHEWRRQRLQRLLVLSPLHPQHQPAGAAHRDHRCLLHPHTHPKAVQAALQHLHDMCHCFQLFINKKAFPTPSKLEDQLVTHSTSGHAPCAGPEAGRALGLLSDEKRPRAPHSRDPREPFVTNPTPREGYERRSPRWGLPGTRPGRTLQARCMEKKAARPHARRWPARRGPEGRGSPSPPGPAAPGGRFPAPPLLCSFLHGPLPFLLLLRKPPPPPRLPCPLFLASPYFLGSAFGWTLPQELDRVQGLFWPLSSLCPSTVPLGPRRRARCHVPCGVCAADGPSARSLVDFALPVVAPCAPDQQPHRPPPRPRFSYAPAPGVLLAPSASLSLLFCKGRARLSDLLLLCMVPCVRINPLEYSWSQFLPVPPPRPDPLLGLPRRREAGGRPGSPGGQLSADPGPLYHASCFLFQSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 826892 - protein, 360 aa, Homo sapiens; identical to SEQ ID NO: 826877

SEQ ID NO: 826893 - protein, 599 aa, Homo sapiens; identical to SEQ ID NO: 826870

SEQ ID NO: 826894 - protein, 360 aa, Homo sapiens; identical to SEQ ID NO: 826877

SEQ ID NO: 826895 - protein, 360 aa, Homo sapiens; identical to SEQ ID NO: 826877

SEQ ID NO: 826896 - protein, 361 aa, Homo sapiens
MNFQAGGGQSPQQQQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTLMNRRPEGCLPKATQRVSWPS

SEQ ID NO: 826897 - protein, 186 aa, Homo sapiens
RVIKDPGIEWHVDLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQEARDRMSV

SEQ ID NO: 826898 - protein, 74 aa, Homo sapiens
GGGQTWEYVQPFLGWNQGAWVGVAAGNMRPLSCFVQKPLEDQTQLLTLVCQLYQGKKPDVCPSSTSSLRSVCFK

SEQ ID NO: 826899 - protein, 250 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826900 - protein, 250 aa, Homo sapiens; identical to SEQ ID NO: 826899

SEQ ID NO: 826901 - protein, 279 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQVCGAGETEARGQGSRGPSLPAGSHPAALQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826902 - protein, 250 aa, Homo sapiens; identical to SEQ ID NO: 826899

SEQ ID NO: 826903 - protein, 231 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQPLSKPQACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826904 - protein, 219 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVECLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826905 - protein, 244 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHENPWKIRPSSLPLSASCTRARSRMSALPQPAPSGVFASSDGR

SEQ ID NO: 826906 - protein, 204 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHAQPAPSGVFASSDGR

SEQ ID NO: 826907 - protein, 124 aa, Homo sapiens
RVGSTRFIVQHSTWIGHTFAPAAMTLSPLLLFLPPLLLLLDVPTAAVQASPLQALDFFGNGPPVNYKTGNLYLRGPLKKSNAPLVNKPLEDQTQLLTLVCQLYQGKKPDVCPSSTSSLRSVCFK

SEQ ID NO: 826908 - protein, 136 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEIEEAPG

SEQ ID NO: 826909 - protein, 107 aa, Homo sapiens
RVGSTRFIVQHSTWIGHTFAPAAMTLSPLLLFLPPLLLLLDVPTAAVQASPLQALDFFGNGPPVNYKTGNLYLRGPLKKSNAPLVNPTSTVIHIRSETFVPDHVVWS

SEQ ID NO: 826910 - protein, 196 aa, Homo sapiens
HTFAPAAMTLSPLLLFLPPLLLLLDVPTAAVQASPLQALDFFGNGPPVNYKVGTATGRAGWREQAPCRGTRLLLSPQTSQGKTRAPRGRCPCRVPGKTLFSSRRCGHTPSVPFRFRIPHLRGAAASTRLVPPKGSMSAYCVLLGQELGSPFVAQGTSSAAGQGPPACILAATLDAFIPARAGLACLWDLLGRCPRG

SEQ ID NO: 826911 - protein, 273 aa, Homo sapiens
RVGSTRFIVQHSTWIGHTFAPAAMTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826912 - protein, 250 aa, Homo sapiens; identical to SEQ ID NO: 826899

SEQ ID NO: 826913 - protein, 250 aa, Homo sapiens; identical to SEQ ID NO: 826899

SEQ ID NO: 826914 - protein, 232 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQKQFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826915 - protein, 250 aa, Homo sapiens; identical to SEQ ID NO: 826899

SEQ ID NO: 826916 - protein, 226 aa, Homo sapiens
VQLADKGKELGLIFQGFPIDGDPGHILVWWLESICPLGVGVHELQCRGPPLPPLLLLLDVPTAAVQASPLQALDFFGNGPPVNYKTGNLYLRGPLKKSNAPLVNVTLYYEALCGGCLAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 826917 - protein, 234 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQQPAPSGVFASSDGR

SEQ ID NO: 826918 - protein, 224 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHAWCPTETHRNKMSVAGGSSSAAWRRGVNSPGAGTE

SEQ ID NO: 826919 - protein, 67 aa, Homo sapiens
TKEEIVDKYDLFVGSQATDFGEALMGNPWKIRPSSLPLSASCTRARSRMSALPQPAPSGVFASSDGR

SEQ ID NO: 826920 - protein, 180 aa, Homo sapiens
VQLADKGKELGLIFQGFPIDGDPGHILVWWLESICPLGVGVHELQCRGPPLPPLLLLLDVPTAAVQASPLQALDFFGNGPPVNYKTGNLYLRGPLKKSNAPLVNVTLYYEALCGGCLAFLTIVCMEEFEDMERSLPLCLQLYAPGLSPDTIMECAMGDRGMQLMHAQPAPSGVFASSDGR

SEQ ID NO: 826921 - protein, 92 aa, Homo sapiens
YQVGLREVGTAQGYTCLPRLPNPQTGNLYLRGPLKKSNAPLVNVTLYYEALCGGCRAFLIRELFPTWLLVMEILNVTLVPYGNAQVCGRWGN

SEQ ID NO: 826922 - protein, 103 aa, Homo sapiens
EDPGIMAEQEAVSPPRPQLHQKDLSDVTILELWKLLKACNFQGRLGWQIGVNFGFSSWHSSGYPCPTDSHAHVLGAPRTQLEGFRVSKKDPFLQIVGICAQDP

SEQ ID NO: 826923 - protein, 1153 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 826924 - protein, 163 aa, Homo sapiens
ARSRNARTADGADRREPVRRRNGSLGVRVESGLVGDDRDEHGAVAGELTVRLLAERDGGAHLRLLHHHRLQRQERPGAAARLADHAVSEAGPAVQDAGTGLGRKPKPGRRAGAAVPGPRAGRPDRPPERQFAPEGGRQGWTSQAFPASPRNLHPSTVNSRACS

SEQ ID NO: 826925 - protein, 219 aa, Homo sapiens
ARAPGTRAPQTARIAGSRSAAGTGAWVCVWSPDSWETIAMNTVLSRANSLFAFSLSVMAALTFGCFITTAFKDRSVPVRLHVSRIMLKNVEDFTGPRERSDLGFITFDITADLENIFDWNVKQLFLYLSAEYSTKNNALNQVVLWDKIVLRGDNPKLLLKDMKTKYFFFDDGNGLKGNRNVTLTLSWNVVPNAGILPLVTGSGHVSVPFPDTYEITKSY

SEQ ID NO: 826926 - protein, 219 aa, Homo sapiens; identical to SEQ ID NO: 826925

SEQ ID NO: 826927 - protein, 219 aa, Homo sapiens; identical to SEQ ID NO: 826925

SEQ ID NO: 826928 - protein, 95 aa, Homo sapiens
ARSRNARTADGADRREPVRRRNGSLGVRVESGLVGDDRDEHGAVAGELTVRLLAERDGGAHLRLLHHHRLQRQERPGAAARLADHAKKCRRFHWT

SEQ ID NO: 826929 - protein, 219 aa, Homo sapiens; identical to SEQ ID NO: 826925

SEQ ID NO: 826930 - protein, 219 aa, Homo sapiens; identical to SEQ ID NO: 826925

SEQ ID NO: 826931 - protein, 219 aa, Homo sapiens; identical to SEQ ID NO: 826925

SEQ ID NO: 826932 - protein, 346 aa, Homo sapiens
PFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 826933 - protein, 268 aa, Homo sapiens [sequence omitted]

SEQ ID NO: 826934 - protein, 268 aa, Homo sapiens [sequence omitted]

SEQ ID NO: 826935 - protein, 96 aa, Homo sapiens
PFVVSCINLAVPCIYSMFRLVERYEMPRHEVYVLLIRNIFLKISIIGILCYYWLNTVALSGEECWETLIGQDIYRLLLMDFVFSLVNSFLGEFLRR

SEQ ID NO: 826936 - protein, 230 aa, Homo sapiens
PASDSLTSHRYRIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 826937 - protein, 255 aa, Homo sapiens
MDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLGE

SEQ ID NO: 826938 - protein, 386 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826939 - protein, 268 aa, Homo sapiens
MMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826940 - protein, 268 aa, Homo sapiens; identical to SEQ ID NO: 826939

SEQ ID NO: 826941 - protein, 286 aa, Homo sapiens
MVWLFLVCFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826942 - protein, 409 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGECLLPSPNSAEEIQGYLMRAAEGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826943 - protein, 362 aa, Homo sapiens
RSAAGTIEPGRWHRPRSCWPGRSEAARPAPAPWGGWWLWACWGSRWRSWARGFWHSEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826944 - protein, 323 aa, Homo sapiens
GAPPDRLSPARPLHPSPPFPSGPHTRLLSPHALSRTGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826945 - protein, 374 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826946 - protein, 368 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEDNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826947 - protein, 301 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKILTISHLEGT

SEQ ID NO: 826948 - protein, 334 aa, Homo sapiens
VKDPLTLYTSRSGFVDSNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826949 - protein, 368 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLTAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826950 - protein, 282 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLDGG

SEQ ID NO: 826951 - protein, 220 aa, Homo sapiens
MTIVVIFSSSFPLTKTNRPFVSSHMLFFFFSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826952 - protein, 285 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYLSWIHWWIIYLLILPRGTSG

SEQ ID NO: 826953 - protein, 386 aa, Homo sapiens; identical to SEQ ID NO: 826938

SEQ ID NO: 826954 - protein, 301 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLEAGIHWVG

SEQ ID NO: 826955 - protein, 268 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYGPL

SEQ ID NO: 826956 - protein, 205 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPRYFLILFLL

SEQ ID NO: 826957 - protein, 133 aa, Homo sapiens
AERGRHHRAGKMAPPTELLARPERGSAPGSRAMGRLVAVGLLGIALALLGERLLALRNRLKASREVESVDLPHCHLIKGIVRAKALSPSFPVCDLEQLLNFSKASNSLHSKIKDNHMRYCMQGIYKEPGTWCT

SEQ ID NO: 826958 - protein, 106 aa, Homo sapiens
MNSVYGVGNTFLKVREPMIRNNTRRTAIGKTENDLLGRLTAYTFNLSLPVVFKCQCLPRGPVVMSCKLTLFFQFFSKFEEAENSLLHLKTVKHELLPRYFLILFLL

SEQ ID NO: 826959 - protein, 386 aa, Homo sapiens; identical to SEQ ID NO: 826938

SEQ ID NO: 826960 - protein, 386 aa, Homo sapiens; identical to SEQ ID NO: 826938

SEQ ID NO: 826961 - protein, 401 aa, Homo sapiens
AERGRHHRAGKMAPPTELLARPERGSAPGSRAMGRLVAVGLLGIALALLGERLLALRNRLKASREVESVDLPHCHLIKGIEAGSEDIDILPNGLAFFSVGECLLPSPNSAEEIQGYLMRAAEHFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826962 - protein, 284 aa, Homo sapiens
MRAAEHFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 826963 - protein, 155 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFRNRKFQHLPPERRIPAFPFLSPQWTLRRLEE

SEQ ID NO: 826964 - protein, 919 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 826965 - protein, 702 aa, Homo sapiens
MMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 826966 - protein, 814 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKK

SEQ ID NO: 826967 - protein, 342 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKGKTQTNKQ

SEQ ID NO: 826968 - protein, 249 aa, Homo sapiens
KLCAGAELASLAGWDWASGAEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 826969 - protein, 210 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDCKAM

SEQ ID NO: 826970 - protein, 190 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRQRRQWNPKKQL

SEQ ID NO: 826971 - protein, 867 aa, Homo sapiens
MLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 826972 - protein, 909 aa, Homo sapiens
DQRGFSEIKEQEMFKGTTSLPSHLKNGGVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 826973 - protein, 285 aa, Homo sapiens
ASWGYPARASAASLAATRGEPEDELNLAAAAISSAHHRVWCLSEEYFTFKGKMLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGPHCRLWNDD

SEQ ID NO: 826974 - protein, 862 aa, Homo sapiens
PAGPGRWPQVGLTARPIRRGPGMAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 826975 - protein, 139 aa, Homo sapiens
PAGPGRWPQVGLTARPIRRGPGMAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRGLHWGHLFQF

SEQ ID NO: 826976 - protein, 862 aa, Homo sapiens; identical to SEQ ID NO: 826974

SEQ ID NO: 826977 - protein, 901 aa, Homo sapiens
PAGPGRWPQVGLTARPIRRGPGMAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGPFIPPAFPGACADPGCWLLVMSAGTRGHAVGLEGAVIMGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 826978 - protein, 890 aa, Homo sapiens
PAGPGRWPQVGLTARPIRRGPGMAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQVAPQPRAHGCSSHCVGERGSASRSLPLQILEAADKTQALDMKRHCLHIIVHQFTKVSKLPTLRSLSQQLLLDIIDSLASHISDKQCAELGADI

SEQ ID NO: 826979 - protein, 862 aa, Homo sapiens; identical to SEQ ID NO: 826974

SEQ ID NO: 826980 - protein, 862 aa, Homo sapiens; identical to SEQ ID NO: 826974

SEQ ID NO: 826981 - protein, 432 aa, Homo sapiens
PAGPGRWPQVGLTARPIRRGPGMAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASEVQAGILIKTPSPPETGPVINPSHTWGD

SEQ ID NO: 826982 - protein, 279 aa, Homo sapiens
PAGPGRWPQVGLTARPIRRGPGMAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNASHVGQVHSLRVGPHTHLPSFHKMWLLPHPQGSLLQIPPGGAYPEASLNQSATLLYADPCH

SEQ ID NO: 826983 - protein, 122 aa, Homo sapiens
NISIGEMVPSRQAFESMLRYIYYGEVNMPPEDSLHPHSPVNSQVPTKGSWHPPRVALRPALLPQLGDLGPAPPSRGFAGAWGWAWCSLKQLAAGKEGFAARRNQWVPDPHNCPEDGVGHCFV

SEQ ID NO: 826984 - protein, 73 aa, Homo sapiens
GGGSKDLCGSKLGSAASWRFVPCHQLFPQAPGCACLGRWAPGSVLTLVSLHGVDDHLQEAKLMKDKGSSPNRH

SEQ ID NO: 826985 - protein, 1651 aa, Homo sapiens
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 826986 - protein, 1651 aa, Homo sapiens; identical to SEQ ID NO: 826985

SEQ ID NO: 826987 - protein, 1651 aa, Homo sapiens; identical to SEQ ID NO: 826985

SEQ ID NO: 826988 - protein, 1612 aa, Homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 826989 - protein, 1645 aa, Homo sapiens
GISRFPRFPSTRVDPISTPSSWHETVYRIHPRTMIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 826990 - protein, 1544 aa, Homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQGN

SEQ ID NO: 826991 - protein, 129 aa, Homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVASK

SEQ ID NO: 826992 - protein, 66 aa, Homo sapiens
LVFEVRTPAKNSVVIPDLRKGVNYEIKARPFFNEFQGADSEIKFAKTLEEGKYDEAFDFHALQYIC

SEQ ID NO: 826993 - protein, 397 aa, Homo sapiens [sequence omitted]

SEQ ID NO: 826994 - protein, 397 aa, Homo sapiens [sequence omitted]

SEQ ID NO: 826995 - protein, 116 aa, Homo sapiens
PPFPPPPPPPPTLLHTPPSLIPTYQPWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 826996 - protein, 178 aa, Homo sapiens
MRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIG

SEQ ID NO: 826997 - protein, 289 aa, Homo sapiens
MRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPCSFSPK

SEQ ID NO: 826998 - protein, 397 aa, Homo sapiens [sequence omitted]

SEQ ID NO: 826999 - protein, 379 aa, Homo sapiens
MRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 827000 - protein, 397 aa, Homo sapiens [sequence omitted]

SEQ ID NO: 827001 - protein, 320 aa, Homo sapiens
MRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFEFFATVHIAAALRT

SEQ ID NO: 827002 - protein, 179 aa, Homo sapiens
MRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGL

SEQ ID NO: 827003 - protein, 226 aa, Homo sapiens
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 827004 - protein, 148 aa, Homo sapiens
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEISSSGSSSKPPSCTSSMSCTTASPCSGW

SEQ ID NO: 827005 - protein, 226 aa, Homo sapiens; identical to SEQ ID NO: 827003

SEQ ID NO: 827006 - protein, 261 aa, Homo sapiens; identical to SEQ ID NO: 767500

SEQ ID NO: 827007 - protein, 124 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPVWRELHTGHLIYKCGGIDKRTIEKFEKEAAEMGQGSFKYAW

SEQ ID NO: 827008 - protein, 87 aa, Homo sapiens
PGSPQVGLRPFTSAGPMLARAHSRLIRARFRDSPWLSPQTLSSLSTEWEALELTDHQWALDDVEEELMAKDLHFEGMFKKELQTSIF

SEQ ID NO: 827009 - protein, 261 aa, Homo sapiens; identical to SEQ ID NO: 767500

SEQ ID NO: 827010 - protein, 299 aa, Homo sapiens
MAGPELLLDSNIRLWVVLPIVIITFFVGMIRHYVSILLQSDKKLTQEQVSDRKYLSGLVQWLTPIIPALWGAEMGGSLEPRNLRPTLAACQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 827011 - protein, 156 aa, Homo sapiens
MLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 827012 - protein, 236 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRTAMAMPADTNKAFKTEWEALELTDHQWALDDVEEELMAKDLHFEGMFKKELQTSIF

SEQ ID NO: 827013 - protein, 111 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTGMFVPFTHL

SEQ ID NO: 827014 - protein, 261 aa, Homo sapiens; identical to SEQ ID NO: 767500

SEQ ID NO: 827015 - protein, 83 aa, Homo sapiens
MAGPELLLDSNIRLWVVLPIVIITFFVGMIRHYVSILLQSDKKLTQEQVSDSQVLIRSRVLRENGKYIPKQSFLTRIFQPQRW

SEQ ID NO: 827016 - protein, 107 aa, Homo sapiens
PSHPFVEKSARCVTASHRVTFRTSHQAFWVLGFFHYTTAITLSFCSISFRTDQSQHPTLERTLRSQLTGRAWWLMPVLPALWEAEADGSRGQEIETILANMVKPRLY

SEQ ID NO: 827017 - protein, 262 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKVYSFTFQSCSNALKGVTKSYFKNSFLEGSVVWFHRFNLNLVKT

SEQ ID NO: 827018 - protein, 226 aa, Homo sapiens
MGGSLEPRNLRPTLAACQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 827019 - protein, 236 aa, Homo sapiens; identical to SEQ ID NO: 827012

SEQ ID NO: 827020 - protein, 108 aa, Homo sapiens
PASEAVVQFSNLCEAHSSPWVLGCLLSPGTHVSVSYATAADQSRMMQEQMTGAAMAMPADTNKAFKTEWEALELTDHQWALDDVEEELMAKDLHFEGMFKKELQTSIF

SEQ ID NO: 827021 - protein, 427 aa, Homo sapiens
MTLVTAGGAWTGPGCWHEVKDEESSSEQSISIAVSHVNTSKAGLPAQTALPCDICGPILKDILHLDEHQGTHHGLKLHTCGACGRQFWFSANLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 827022 - protein, 505 aa, Homo sapiens
GIFLAVDILSALRWNHRSRSSGLLGGSEVTEAGGCGRSRCSLCGVARQRRPRLRPRGRTTAVPGSRDLGPPRGSGWSTNCDGGGRGDGPGAGCWHEVKDEESSSEQSISIAVSHVNTSKAGLPAQTALPCDICGPILKDILHLDEHQGTHHGLKLHTCGACGRQFWFSANLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 827023 - protein, 1912 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827024 - protein, 1912 aa, Homo sapiens; identical to SEQ ID NO: 827023

SEQ ID NO: 827025 - protein, 1885 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFTIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827026 - protein, 1885 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRVELRRLNFQTPGSDDSGYPGNLHSSSMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFTIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827027 - protein, 1059 aa, Homo sapiens
MNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFTIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827028 - protein, 1484 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVRISIHLFPFKNFPSESLCCIFYSVQNLTFP

SEQ ID NO: 827029 - protein, 617 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSSRCLSLLTFCLFISSGRCC

SEQ ID NO: 827030 - protein, 202 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGTDFSPSSLSLLLNGWSMFVMS

SEQ ID NO: 827031 - protein, 101 aa, Homo sapiens
LTWLNNTPCFPGIPGSDYVNANYIDGYRKQNAYIATQGSLPETFGDFWRMIWEQRSATVVMMTKLEERSRVRISIHLFPFKNFPSESLCCIFYSVQNLTFP

SEQ ID NO: 827032 - protein, 1912 aa, Homo sapiens; identical to SEQ ID NO: 827023

SEQ ID NO: 827033 - protein, 1903 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827034 - protein, 1141 aa, Homo sapiens
MENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFTIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827035 - protein, 712 aa, Homo sapiens
LERLKKIRAQEGCVTSGAFVSSSCRIRHYGGFTNKQLQSGQEYVFFVLAVMEHAESKMYATSPYSDPVVSMDLDPQPITDEEEGLIWVVGPVLAVVFIICIVIAILLYKSKPDRKRAESDSRVELRRLNFQTPGSDDSGYPGNLHSSSMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFTIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 827036 - protein, 712 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDGMLPPLRQFAPF

SEQ ID NO: 827037 - protein, 768 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQVSL

SEQ ID NO: 827038 - protein, 113 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKINRESFL

SEQ ID NO: 827039 - protein, 113 aa, Homo sapiens; identical to SEQ ID NO: 827038

SEQ ID NO: 827040 - protein, 113 aa, Homo sapiens; identical to SEQ ID NO: 827038

SEQ ID NO: 827041 - protein, 113 aa, Homo sapiens; identical to SEQ ID NO: 827038

SEQ ID NO: 827042 - protein, 113 aa, Homo sapiens; identical to SEQ ID NO: 827038

SEQ ID NO: 827043 - protein, 113 aa, Homo sapiens; identical to SEQ ID NO: 827038

SEQ ID NO: 827044 - protein, 113 aa, Homo sapiens; identical to SEQ ID NO: 827038

SEQ ID NO: 827045 - protein, 113 aa, Homo sapiens; identical to SEQ ID NO: 827038

SEQ ID NO: 827046 - protein, 368 aa, Homo sapiens
SLLAVCSFRRLVRSGFPGLPCQDSDSNHLPKMSLSAFTLFLALIGGTSGQYYDYDFPLSIYGQSSPNCAPECNCPESYPSAMYCDELKLKSVPMVPPGIKYLYLGVPRFAPFGGRAFGIVAGLPWLFLGPPLLGPSRVPGGVFSSLAPLTRLPARHALTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 827047 - protein, 113 aa, Homo sapiens; identical to SEQ ID NO: 827038

SEQ ID NO: 827048 - protein, 113 aa, Homo sapiens; identical to SEQ ID NO: 827038

SEQ ID NO: 827049 - protein, 113 aa, Homo sapiens; identical to SEQ ID NO: 827038

SEQ ID NO: 827050 - protein, 113 aa, Homo sapiens; identical to SEQ ID NO: 827038

SEQ ID NO: 827051 - protein, 113 aa, Homo sapiens; identical to SEQ ID NO: 827038

SEQ ID NO: 827052 - protein, 113 aa, Homo sapiens; identical to SEQ ID NO: 827038

SEQ ID NO: 827053 - protein, 126 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIPDRVCGPTSQISGGSAAYS

SEQ ID NO: 827054 - protein, 142 aa, Homo sapiens
SLLQPIRFAQPWPCYGKCPCSSLIPYEILGALLVLAFSALSLARAWNPDPLYANDIFQELLRYLDRSSKHRVSYHYYEPLPESKSTALSKVQFDIKSFCKILGPLSYSKIKHLRLDGNRISETSLPPDMYECLRVANEVTLN

SEQ ID NO: 827055 - protein, 896 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 827056 - protein, 582 aa, Homo sapiens
MYLKSDSGLGGWITIPAVADVLKYSCIVCWSSREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 827057 - protein, 403 aa, Homo sapiens
MKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 827058 - protein, 896 aa, Homo sapiens; identical to SEQ ID NO: 827055

SEQ ID NO: 827059 - protein, 896 aa, Homo sapiens; identical to SEQ ID NO: 827055

SEQ ID NO: 827060 - protein, 684 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITS

SEQ ID NO: 827061 - protein, 370 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQRAQEIMWDRIMKVPGDKYDTEVNR

SEQ ID NO: 827062 - protein, 896 aa, Homo sapiens; identical to SEQ ID NO: 827055

SEQ ID NO: 827063 - protein, 759 aa, Homo sapiens
MGCKMNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 827064 - protein, 514 aa, Homo sapiens
MYLKSDSGLGGWITIPAVADVLKYSCIVCWSSREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 827065 - protein, 896 aa, Homo sapiens; identical to SEQ ID NO: 827055

SEQ ID NO: 827066 - protein, 896 aa, Homo sapiens; identical to SEQ ID NO: 827055

SEQ ID NO: 827067 - protein, 198 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVIFLIFHKSQMK

SEQ ID NO: 827068 - protein, 339 aa, Homo sapiens [sequence omitted]

SEQ ID NO: 827069 - protein, 203 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKSSTDRS

SEQ ID NO: 827070 - protein, 339 aa, Homo sapiens [sequence omitted]

SEQ ID NO: 827071 - protein, 339 aa, Homo sapiens [sequence omitted]

SEQ ID NO: 827072 - protein, 339 aa, Homo sapiens [sequence omitted]

SEQ ID NO: 827073 - protein, 277 aa, Homo sapiens [sequence omitted]

SEQ ID NO: 827074 - protein, 339 aa, Homo sapiens [sequence omitted]

SEQ ID NO: 827075 - protein, 339 aa, Homo sapiens [sequence omitted]

SEQ ID NO: 827076 - protein, 258 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQYQESVGDG

SEQ ID NO: 827077 - protein, 173 aa, Homo sapiens
MVPSKTKGLGVLGCWHFWCSSCSSSAPAAPKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 827078 - protein, 325 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFASSEQ

SEQ ID NO: 827079 - protein, 240 aa, Homo sapiens [sequence omitted]

SEQ ID NO: 827080 - protein, 130 aa, Homo sapiens
PRPPGQVRQGGREGPRASTPQDPGVCPCDIPFCCPQDIVAGDMSKKSLWEQKGGSKTSSTIKVEPKCGWCRQGGCSRGGQRGTVLCASGRASQRRRQHHLLSAALTFTLGLLSQQSTPSGKRYKFVATGH

SEQ ID NO: 827081 - protein, 154 aa, Homo sapiens
CGVTVPLCPPLGPLLSGAWRTRRRPSTSNASMRETGSFRPRTRREAAMSPSGRSRRCCEQPHNACLGSSPYPCTLGPGQRGRSRAWAWGFQCRMRARKGPQEQAWEWVSAPGARVATALEEGLPIPGCLLGADPGSVSVPWPLLGPPLTPATQP

SEQ ID NO: 827082 - protein, 240 aa, Homo sapiens [sequence omitted]

SEQ ID NO: 827083 - protein, 150 aa, Homo sapiens
ESQGRDLETEGGSGRGLGRLGEALWETWGLTHLLPSSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFASSEQ

SEQ ID NO: 827084 - protein, 339 aa, Homo sapiens [sequence omitted]

SEQ ID NO: 827085 - protein, 277 aa, Homo sapiens [sequence omitted]

SEQ ID NO: 827086 - protein, 330 aa, Homo sapiens [sequence omitted]

SEQ ID NO: 827087 - protein, 356 aa, Homo sapiens
RQELCQGSPSWPRRRSAPEGRRAKAGGAAGLSVDLPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 827088 - protein, 339 aa, Homo sapiens [sequence omitted]

SEQ ID NO: 827089 - protein, 322 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKSTPSGKRYKFVATGHGKYEKVLVEGGPAP

SEQ ID NO: 827090 - protein, 123 aa, Homo sapiens
MGSMRRCLWKGARLPRRPISLPGSAGPAGWHPPCTQGRFQPDTRPPALAKKLLPVASMTYPRLFDAIRCHLLLLLDPLASLPFHSLTTAPALPTQLRFLLLGGGKKLLIIGQRDLPLERPSAF

SEQ ID NO: 827091 - protein, 249 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETWPDPATAGS

SEQ ID NO: 827092 - protein, 134 aa, Homo sapiens
LTPIVGLKAATKLRKPQHVHPLQGSASTLWGPDYRLMAEASSDPGAEEREELLGPTAQWSVEDEEEAVHEQCQHERDRQLQAQDEEGGGHVPERPKQEMLLSLKPSEAPELDEDEGFGDWSQRPEQRQQFLLPA

SEQ ID NO: 827093 - protein, 286 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLGRQIQHQPTVGGIHKRRVTLRVWVGVWGGPSTMAGTSAGRVSAGPGGDFPAR

SEQ ID NO: 827094 - protein, 424 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827095 - protein, 424 aa, Homo sapiens; identical to SEQ ID NO: 827094

SEQ ID NO: 827096 - protein, 424 aa, Homo sapiens; identical to SEQ ID NO: 827094

SEQ ID NO: 827097 - protein, 424 aa, Homo sapiens; identical to SEQ ID NO: 827094

SEQ ID NO: 827098 - protein, 424 aa, Homo sapiens; identical to SEQ ID NO: 827094

SEQ ID NO: 827099 - protein, 424 aa, Homo sapiens; identical to SEQ ID NO: 827094

SEQ ID NO: 827100 - protein, 424 aa, Homo sapiens; identical to SEQ ID NO: 827094

SEQ ID NO: 827101 - protein, 397 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKLNRTLKKMGQRP

SEQ ID NO: 827102 - protein, 396 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKVCLSPGLGVLY

SEQ ID NO: 827103 - protein, 424 aa, Homo sapiens; identical to SEQ ID NO: 827094

SEQ ID NO: 827104 - protein, 265 aa, Homo sapiens
SFSVFPAVLASEAAMSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLGRQIQHQPTVGGIHKRR

SEQ ID NO: 827105 - protein, 424 aa, Homo sapiens; identical to SEQ ID NO: 827094

SEQ ID NO: 827106 - protein, 424 aa, Homo sapiens; identical to SEQ ID NO: 827094

SEQ ID NO: 827107 - protein, 424 aa, Homo sapiens; identical to SEQ ID NO: 827094

SEQ ID NO: 827108 - protein, 265 aa, Homo sapiens; identical to SEQ ID NO: 827104

SEQ ID NO: 827109 - protein, 265 aa, Homo sapiens; identical to SEQ ID NO: 827104

SEQ ID NO: 827110 - protein, 404 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSRDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827111 - protein, 326 aa, Homo sapiens
TLRIRRWLWVAGSGFKARDGGREGGGRDRERETDILVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827112 - protein, 261 aa, Homo sapiens
MYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827113 - protein, 261 aa, Homo sapiens; identical to SEQ ID NO: 827112

SEQ ID NO: 827114 - protein, 185 aa, Homo sapiens
MRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827115 - protein, 424 aa, Homo sapiens; identical to SEQ ID NO: 827094

SEQ ID NO: 827116 - protein, 424 aa, Homo sapiens; identical to SEQ ID NO: 827094

SEQ ID NO: 827117 - protein, 424 aa, Homo sapiens; identical to SEQ ID NO: 827094

SEQ ID NO: 827118 - protein, 457 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEEMESCAVTHAGVQRRDLSSLQPLPPGFKRVSLLSLPHSWNYSLIEP

SEQ ID NO: 827119 - protein, 432 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTALGPLDVSKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827120 - protein, 405 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKVCLSPGLGLNRTLKKMGQRP

SEQ ID NO: 827121 - protein, 424 aa, Homo sapiens; identical to SEQ ID NO: 827094

SEQ ID NO: 827122 - protein, 404 aa, Homo sapiens; identical to SEQ ID NO: 827110

SEQ ID NO: 827123 - protein, 393 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTGQKKIGAVCFTHKTGGPVTRGLNPGRRRTPATGRGVPQGPKGDNVGPTPLR

SEQ ID NO: 827124 - protein, 432 aa, Homo sapiens
GRVGRPTRPTHASGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827125 - protein, 601 aa, Homo sapiens
SFSGFPAVLASEAAMSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAATCLHYYTRVIILSRGPSISDPNDQLERTRSIERSDVFRDLYYNFTGKSLFISNYFLRGRWKLFPLNLATIEEELFGVVTRLRFIYQFRGFSHSVSTAVRLPRSQRRRLTFFVPIPKSGMFIVSSMSFIPWVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827126 - protein, 265 aa, Homo sapiens; identical to SEQ ID NO: 827104

SEQ ID NO: 827127 - protein, 265 aa, Homo sapiens; identical to SEQ ID NO: 827104

SEQ ID NO: 827128 - protein, 280 aa, Homo sapiens
MAYGNYVLVQENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827129 - protein, 311 aa, Homo sapiens
MPKSVGDLPWSRGLNPITTTAISSTTFLMPMVLLPLNYPTSGSGILSMSSSTSFSHSVSTAVRLPRSQRRRLTFFVPIPKSGMFIVSSMSFIPWVDKSNINRQLEVYTSGGDPESVAGEYGRHSRDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQRGPFNIGDQRLTQTWTWGL

SEQ ID NO: 827130 - protein, 231 aa, Homo sapiens
GRVGRPTRPTHASKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827131 - protein, 166 aa, Homo sapiens
MSRQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 827132 - protein, 501 aa, Homo sapiens
ARCWAAAAAAAVVTMAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGTFLFCLCSYLPFQDAGSPKAVLLPPFFLQPVGCLLPEPESSFKVAIKGVEVAVLRVRLFFRDQFVE

SEQ ID NO: 827133 - protein, 519 aa, Homo sapiens
ARCWAAAAAAAVVTMAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 827134 - protein, 395 aa, Homo sapiens
ARCWAAAAAAAVVTMAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRSP

SEQ ID NO: 827135 - protein, 243 aa, Homo sapiens
GTHLWFSADNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 827136 - protein, 125 aa, Homo sapiens
MAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 827137 - protein, 227 aa, Homo sapiens
ARCWAAAAAAAVVTMAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGTKFFRASCLWLAFISFPAG

SEQ ID NO: 827138 - protein, 490 aa, Homo sapiens
ARCWAAAAAAAVVTMAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEVRSWPPAAFPSA

SEQ ID NO: 827139 - protein, 519 aa, Homo sapiens; identical to SEQ ID NO: 827133

SEQ ID NO: 827140 - protein, 101 aa, Homo sapiens
FMCDCKNRALDFGSVNLRSSEVQVALWIQGSLWDLPTHVHSQATSPLPSWPFCPYPTHSPTLPPLGKMEQVFGKLPHPPLPLLTLSESWGETEAVFLAPRG

SEQ ID NO: 827141 - protein, 81 aa, Homo sapiens
SCLQANYTCETDGACMVSIFNLDGMEHHVRTCIPKVELVPAGKPFYCLSSEDLRNTHCCYTDYCNRIDLRVPSGECMPLLG

SEQ ID NO: 827142 - protein, 461 aa, Homo sapiens
VRGCCCVRPPAGAGMELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGLC

SEQ ID NO: 827143 - protein, 198 aa, Homo sapiens [sequence omitted]

SEQ ID NO: 827144 - protein, 526 aa, Homo sapiens
VRGCCCVRPPAGAGMELGGHWDMNSAPRLVSETAERKQEQKTGTEAEAADSGAVGARRFLLCLYLVGFLDLFGVSMVVPLLSLHVKSLGASPTVAGIVDDVCSKRFSDLSTITKSHATSGNRYLWSLCKELAVCKKGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 827145 - protein, 526 aa, Homo sapiens; identical to SEQ ID NO: 827144

SEQ ID NO: 827146 - protein, 488 aa, Homo sapiens
VRGCCCVRPPAGAGMELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 827147 - protein, 198 aa, Homo sapiens [sequence omitted]

SEQ ID NO: 827148 - protein, 526 aa, Homo sapiens; identical to SEQ ID NO: 827144

SEQ ID NO: 827149 - protein, 488 aa, Homo sapiens
MVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827150 - protein, 540 aa, Homo sapiens
MVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGEEAEGSLPYPGVGGIGEGGWSQSLQSMGRMCGPSLELPLLLAPPVSPTSLQGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827151 - protein, 488 aa, Homo sapiens; identical to SEQ ID NO: 827149

SEQ ID NO: 827152 - protein, 324 aa, Homo sapiens
MVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARLPCVPNRWKLLRELSRGPGP

SEQ ID NO: 827153 - protein, 360 aa, Homo sapiens
YDGLLGNNQIFPKTGLLIIVLGTIAMEGDSASEEEIWEELGVWGCMMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827154 - protein, 158 aa, Homo sapiens
MCGPSLELPLLLAPPVSPTSLQGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827155 - protein, 158 aa, Homo sapiens; identical to SEQ ID NO: 827154

SEQ ID NO: 827156 - protein, 104 aa, Homo sapiens
MLFRTVLHLPSVDVSTAEMMPENLRKNLTELLRAALKIRICLEKQPDPFAPRQKKTLQEVQEDFVFSKYRHRALLLPELRAACAQELDCLEAAVLSQPWSRGLS

SEQ ID NO: 827157 - protein, 444 aa, Homo sapiens
MVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827158 - protein, 501 aa, Homo sapiens
MVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQKGKERIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827159 - protein, 404 aa, Homo sapiens
YDGLLGNNQIFPKTGLLIIVLGTIAMEGDSASEEEIWEELGVWGCMMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827160 - protein, 318 aa, Homo sapiens
VEKLPVRYGSRYVCLGQIQDVGLMVQDHVRAPGVVSIYLVHTVTRIKADVGSCTGCQEGYSQLAGSESLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 827161 - protein, 132 aa, Homo sapiens
MENAHTKTVEEVLGHFGVNESTGLSLEQVKKLKERWGSNELPAEERSAAGARRGRESQGRWLTGLHLVGFGSAPADSCGRRVGPARRPRGRERGCGPRLAFPGPLRFSGPRPFRRARLGGFSPAAAGPGGGR

SEQ ID NO: 827162 - protein, 111 aa, Homo sapiens
MFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVSI

SEQ ID NO: 827163 - protein, 1043 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827164 - protein, 1043 aa, Homo sapiens; identical to SEQ ID NO: 827163

SEQ ID NO: 827165 - protein, 880 aa, Homo sapiens
RREEMHLEDSANFIKYETNLTFVGCVGMLDPPENRGVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827166 - protein, 1043 aa, Homo sapiens; identical to SEQ ID NO: 827163

SEQ ID NO: 827167 - protein, 468 aa, Homo sapiens
MVLRTSAFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827168 - protein, 1043 aa, Homo sapiens; identical to SEQ ID NO: 827163

SEQ ID NO: 827169 - protein, 345 aa, Homo sapiens
MTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827170 - protein, 1043 aa, Homo sapiens; identical to SEQ ID NO: 827163

SEQ ID NO: 827171 - protein, 288 aa, Homo sapiens
MRERMNCFMLANVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827172 - protein, 1043 aa, Homo sapiens; identical to SEQ ID NO: 827163

SEQ ID NO: 827173 - protein, 1043 aa, Homo sapiens; identical to SEQ ID NO: 827163

SEQ ID NO: 827174 - protein, 1043 aa, Homo sapiens; identical to SEQ ID NO: 827163

SEQ ID NO: 827175 - protein, 267 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVALFPLLGYWLLRRRCYRGCCCMVVHCC

SEQ ID NO: 827176 - protein, 109 aa, Homo sapiens
DPFMSGSDSTSSSLCRTLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827177 - protein, 1043 aa, Homo sapiens; identical to SEQ ID NO: 827163

SEQ ID NO: 827178 - protein, 1043 aa, Homo sapiens; identical to SEQ ID NO: 827163

SEQ ID NO: 827179 - protein, 930 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNRTSGSWAPSACPCHSTS

SEQ ID NO: 827180 - protein, 82 aa, Homo sapiens
LRYGEFRRPASDQYDVQLSLQFVLKGAFGPKGGVKKTLVVLCLRGRRLLLCCVGSHRNCILNVQALIVICDVHFMQVSAGLV

SEQ ID NO: 827181 - protein, 913 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLSKSEMLVLKP

SEQ ID NO: 827182 - protein, 112 aa, Homo sapiens [sequence omitted]

SEQ ID NO: 827183 - protein, 1043 aa, Homo sapiens; identical to SEQ ID NO: 827163

SEQ ID NO: 827184 - protein, 112 aa, Homo sapiens [sequence omitted]

SEQ ID NO: 827185 - protein, 135 aa, Homo sapiens
KSHRCMPRTSRIGGRLHTLFTRFQVVAGHKLERLIHENHGQGDFQHHQPLGHVQRCDLEDEWQGFDIEDRKAVLLLAAHFSINLTLCTTNQDLVLLPVSLLSQLQRLCLPHGVFLQSLYSVARRHEESVSLSQCF

SEQ ID NO: 827186 - protein, 1025 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGLLKISLPVILMDETLKEIFSTISHENLLARD

SEQ ID NO: 827187 - protein, 374 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSDGNPWLYFCYLLRQDWYTYNKPDVSLQDVHSGQSGR

SEQ ID NO: 827188 - protein, 450 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKNVSLGKQLQFVNLK

SEQ ID NO: 827189 - protein, 370 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRVRGVI

SEQ ID NO: 827190 - protein, 189 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGKYDILSH

SEQ ID NO: 827191 - protein, 92 aa, Homo sapiens
GAFPHLSLLCSLSENQSLLRMPPWENIWLVGSICLSMSLHFLILYVEPLPVSGWVGLGTSHLLPGEAGGVTRLPCVSAHLPDHTAERDPVAD

SEQ ID NO: 827192 - protein, 997 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAILE

SEQ ID NO: 827193 - protein, 1043 aa, Homo sapiens; identical to SEQ ID NO: 827163

SEQ ID NO: 827194 - protein, 918 aa, Homo sapiens
MGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAGKECVQPATKSCSFSACTDGISWPFVLLIMPLVIWVYSTDTNFSDMFWS

SEQ ID NO: 827195 - protein, 2717 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRFPAQNKTLEGVTDPLQLLSPRQHPLLCHREKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 827196 - protein, 2726 aa, Homo sapiens
MLSWVPWRRVTGLHGVALPHGLDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRFPAQNKTLEGVTDPLQLLSPRQHPLLCHREKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT
